United States Patent
Fernandez-Cuesta et al.

(10) Patent No.: US 10,208,354 B2
(45) Date of Patent: Feb. 19, 2019

(54) NRG1 FUSION GENES IN CANCER

(71) Applicant: Universität zu Köln, Köln (DE)

(72) Inventors: Lynnette Fernandez-Cuesta, Lyons (FR); Julie George, Köln (DE); Dennis Plenker, Bonn (DE); Roman Thomas, Bornheim (DE)

(73) Assignee: Universität zu Köln, Köln (DE)

( * ) Notice: Subject to any disclaimer, the term of this patent is extended or adjusted under 35 U.S.C. 154(b) by 55 days.

(21) Appl. No.: 14/910,639

(22) PCT Filed: Aug. 7, 2014

(86) PCT No.: PCT/EP2014/067043
§ 371 (c)(1),
(2) Date: Feb. 5, 2016

(87) PCT Pub. No.: WO2015/018918
PCT Pub. Date: Feb. 12, 2015

(65) Prior Publication Data
US 2016/0312288 A1    Oct. 27, 2016

(30) Foreign Application Priority Data

Aug. 7, 2013  (EP) .................................... 13179596
Dec. 19, 2013  (EP) .................................... 13198520

(51) Int. Cl.
*C12Q 1/6886* (2018.01)
*G01N 33/574* (2006.01)
*C07K 14/705* (2006.01)
*C07K 14/475* (2006.01)

(52) U.S. Cl.
CPC ........ *C12Q 1/6886* (2013.01); *C07K 14/4756* (2013.01); *C07K 14/70596* (2013.01); *C07K 2319/00* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

2010/0221737 A1    9/2010   Gu et al.

OTHER PUBLICATIONS

Zhang et al Biological Trace Elements Research. Online Jun. 5, 2012. 159: 258-263.*
Acquaviva et al., "The multifaceted roles of the receptor tyrosine kinase ROS in development and cancer," *Biochim Biophys Acta.*, 1795(1):37-52, 2009.
Chua et al., "The NRG1 gene is frequently silenced by methylation in breast cancers and is a strong candidate for the 8p tumour suppressor gene," *Oncogene*, 28(46):4041-4052, 2009.
Fernandez-Cuesta et al., "CD74-NRG1 fusions in lung adenocarcinoma," *Cancer Discovery*, 4(4):415-422, 2014.
PCT International Preliminary Report on Patentability issued in International Application No. PCT/EP2014/067043, dated Feb. 18, 2016.
PCT International Search Report and Written Opinion issued in International Application No. PCT/EP2014/067043, dated Oct. 21, 2014.
Pole et al., "High-resolution analysis of chromosome rearrangements on 8p in breast, colon and pancreatic cancer reveals a complex pattern of loss, gain and translocation," *Oncogene*, 25(41):5693-5706, 2006.
Wang et al., "Localisation of neuregulin 1-beta3 to different subnuclear structures alters gene expression," *Experimental Cell Research*, 317(4):423-432, 2011.
Wilson et al., "Neuregulin-1-mediated autocrine signaling underlies sensitivity to HER2 kinase inhibitors in a subset of human cancers," *Cancer Cell*, 20(2):158-172, 2011.
Zhang et al., "Fusion genes in epithelial neoplasia," *Journal of Clinical Pathology*, 63(1):4-11, 2010.

* cited by examiner

*Primary Examiner* — Carla J Myers
(74) *Attorney, Agent, or Firm* — Parker Highlander PLLC

(57) ABSTRACT

The present invention relates to novel fusion genes comprising NRG1 and a further fusion partner, like CD74. The present invention provides for the use of these fusion genes in diagnosis as well as in medical intervention in cancer.

14 Claims, 17 Drawing Sheets

Figure 1:
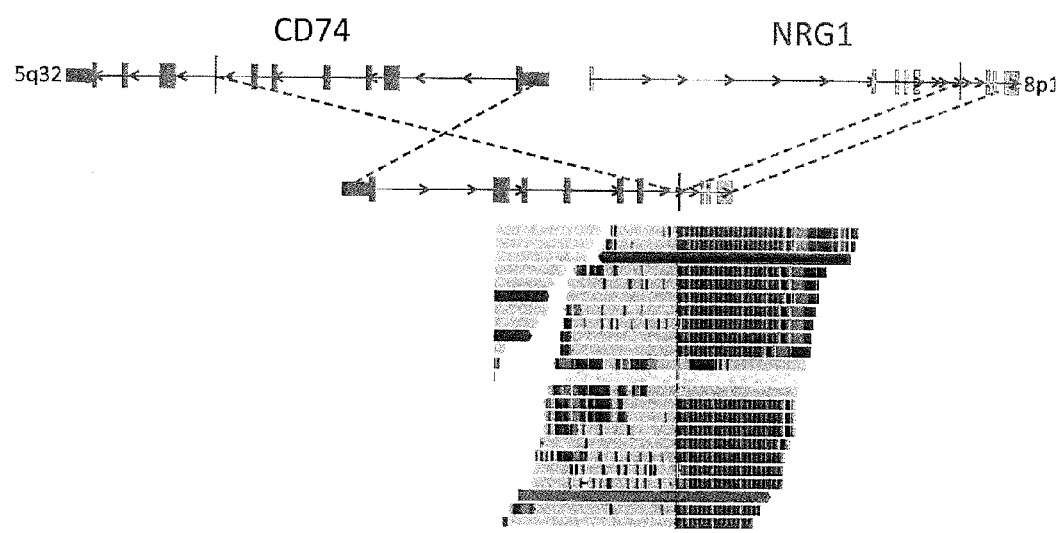

Specification includes a Sequence Listing.

Figure 1.

a.

| Sample | Age | Sex | Stage | Driver |
|---|---|---|---|---|
| S00686 | 68 | male | Ia | EML4-ALK |
| S00688 | 46 | female | Ia | EML4-ALK |
| S00754 | 39 | female | IIIa | EML4-ALK |
| S00664 | 56 | female | IIIb | CD74-ROS1 |
| S00687 | 60 | female | Ia | CD74-ROS1 |
| S00545 | 68 | female | IIIb | EZR-ROS1 |
| S00751 | 65 | female | IIa | KIF5B-RET |
| S01465 | 75 | male | Ia | KIF5B-RET |
| S01276 | 66 | female | IIIb | CCDC6-RET |
| S01052* | 64 | female | Ib | CD74-NRG1 |
| S00557 | 72 | female | IV | |
| S00585 | 74 | male | IV | |
| S00611 | 50 | female | IV | |
| S00684 | 70 | female | Ia | |
| S00726 | 79 | female | IIa | |
| S00737 | 72 | male | IV | |
| S00738 | 59 | male | Ib | Unknown |
| S00747 | 63 | female | IIIa | |
| S00752 | 48 | male | IIIb | |
| S00755 | 71 | female | IIIa | |
| S01156 | 74 | female | IIIa | |
| S01194 | 73 | male | Ib | |
| S01272 | 80 | female | Ib | |
| S01337 | 66 | female | IIIa | |

*Index case (Invasive Mucinous Adenocarcinoma)

Figure 1 (cont.).

b.

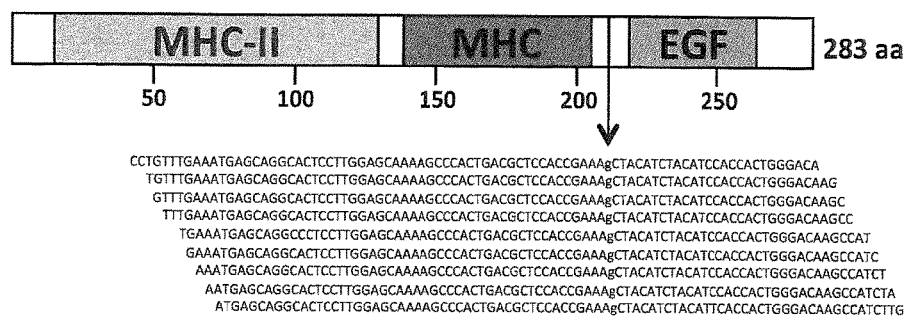

```
CCTGTTTGAAATGAGCAGGCACTCCTTGGAGCAAAAGCCCACTGACGCTCCACCGAAAgCTACATCTACATCCACCACTGGGACA
 TGTTTGAAATGAGCAGGCACTCCTTGGAGCAAAAGCCCACTGACGCTCCACCGAAAgCTACATCTACATCCACCACTGGGACAAG
  GTTTGAAATGAGCAGGCACTCCTTGGAGCAAAAGCCCACTGACGCTCCACCGAAAgCTACATCTACATCCACCACTGGGACAAGC
   TTTGAAATGAGCAGGCACTCCTTGGAGCAAAAGCCCACTGACGCTCCACCGAAAgCTACATCTACATCCACCACTGGGACAAGCC
    TGAAATGAGCAGGCCCTCCTTGGAGCAAAAGCCCACTGACGCTCCACCGAAAgCTACATCTACATCCACCACTGGGACAAGCCAT
     GAAATGAGCAGGCACTCCTTGGAGCAAAAGCCCACTGACGCTCCACCGAAAgCTACATCTACATCCACCACTGGGACAAGCCATC
      AAATGAGCAGGCACTCCTTGGAGCAAAAGCCCACTGACGCTCCACCGAAAgCTACATCTACATCCACCACTGGGACAAGCCATCT
       AATGAGCAGGCACTCCTTGGAGCAAAAGCCCACTGACGCTCCACCGAAAgCTACATCTACATCCACCACTGGGACAAGCCATCTA
        ATGAGCAGGCACTCCTTGGAGCAAAAGCCCACTGACGCTCCACCGAAAgCTACATCTACATTCACCACTGGGACAAGCCATCTTG
``` c.

NRG1 break-apart FISH    CD74-NRG1 fusion assay

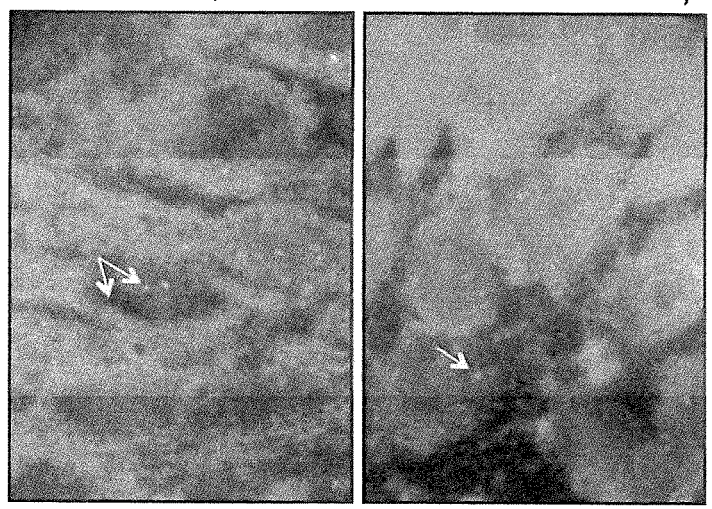

d.

a.

b.

c.

d.

e.

Figure 3.
Cases for gene translocations of
NRG1 in small cell lung cancer:
➢ Analysis: RNA-seq

| Sample | Uniquely mapped reads | Fusion | | | Encompassing reads | Spanning reads | Total reads |
|---|---|---|---|---|---|---|---|
| S02241 | 42,379,782 | NRG1(NM_013960)-MTSS1(NM_014751) | <<-Intra_C | 0-580(-)chr8:32453344-32599572 | 579-1132(+)chr8:125711766-125740541 | 14(14+10) | 56 | 70 | a.
NRG1 Gene Fusion Event in Small Cell Lung Cancer (SCLC)
(case: primary tumor S02241)
Intra_Chromosomal Rearrangement (chromosome 8): MTSS1-NRG1

| p-ERBB3 | CD74-NRG1 (n=5) | AD cohort (n=241) |
|---|---|---|
| positive | 5 | 6 |
| negative | 0 | 235 |
| | | $p$-value<0.0001 | a b a b

Genomic Breakpoints of the MTSS1-NRG1 Translocation

NRG1 FUSION GENES IN CANCER

This application is a national phase application under 35 U.S.C. § 371 of International Application No. PCT/EP2014/067043, filed Aug. 7, 2014, which claims benefit of European Application No. 13179596.5, filed Aug. 7, 2013 and European Application No. 13198520.2, filed Dec. 19, 2013, each of which is specifically incorporated herein by reference.

The present invention relates to novel fusion genes comprising NRG1 and a further fusion partner, like CD74. The present invention provides for the use of these fusion genes in diagnosis as well as in medical intervention in cancer.

Adelaide describes a recurrent chromosome translocation breakpoint that targets the NRG1 gene on 8p12 (Adelaide (2003) Genes, chromosomes and cancer 37:333-345). However, Adelaide does not disclose NRG1 fusion genes or propose their use in diagnostic or therapeutic intervention.

Thus, the technical problem underlying the present invention is the provision of means and methods for the diagnosis and therapeutic intervention in cancer and for the assessment of tumor cells for their responsiveness to anti-cancer treatment.

The technical problem is solved by provision of the embodiments characterized in the claims.

Accordingly, the present invention relates to a nucleic acid selected from the group consisting of
(a) a nucleic acid encoding a polypeptide comprising an amino acid sequence as depicted in SEQ ID NO:1 (CD74-NRG1);
(b) a nucleic acid comprising a nucleotide sequence as depicted in SEQ ID NO: 2 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

Furthermore, the present invention relates to a method for assessing whether a patient suffers from cancer or is prone to suffering from cancer, said method comprising
determining the presence of a fusion gene in a sample from said patient; and
assessing that said patient suffers from cancer or is prone to suffering from cancer when said fusion gene is present,
wherein said fusion gene comprises a nucleic acid encoding an NRG1 protein or a fragment of said protein and wherein said fusion gene comprises a nucleic acid encoding a further protein or a fragment thereof. Preferably, said further protein is a CD74 protein.

The present invention solves the above identified technical problem since, as documented herein below and in the appended examples, it was surprisingly found that novel fusion genes, like CD74-NRG1, are characteristic of cancer. This allows the diagnosis of cancer and therapy with agents that interfere with NRG1 activity and NRG1 associated pathways. A subset of patients suffering from lung cancer (particularly invasive mucinous adenocarcinoma) showed presence of the novel fusion gene though the patients never smoked, whereas other usually occurring markers (like KRAS mutations) were absent. Thus, the present invention provides for the advantageous diagnosis of cancer in patients that do not necessarily belong to a risk group (smokers) and that would not be reliably diagnosed by conventional marker analysis. These patients benefit from such an (early) diagnosis because appropriate therapeutic measures (like surgical intervention and/or chemotherapy) can be taken shortly after diagnosis.

The invention relates to the following items:
1. A nucleic acid selected from the group consisting of
   (a) a nucleic acid encoding a polypeptide comprising an amino acid sequence as depicted in SEQ ID NO:1 (CD74-NRG1);
   (b) a nucleic acid comprising a nucleotide sequence as depicted in SEQ ID NO: 2 (CD74-NRG1);
   (c) a nucleic acid hybridizing under stringent conditions to the complementary strand of the nucleic acid as defined in (a) or (b);
   (d) a nucleic acid comprising a nucleotide sequence with at least 70% identity to the nucleotide sequence of the nucleic acids of any one of (a) to (c); and
   (e) a nucleic acid comprising a nucleotide sequence which is degenerate as a result of the genetic code to the nucleotide sequence of a nucleic acid of any one of (a) to (d).
2. The nucleic acid according to item 1, wherein said nucleic acid is selected from the group consisting of
   (a) a nucleic acid encoding a polypeptide comprising an amino acid sequence as depicted in SEQ ID NO:1 (CD74-NRG1);
   (b) a nucleic acid comprising a nucleotide sequence as depicted in SEQ ID NO: 2 (CD74-NRG1); and
   (c) a nucleic acid comprising a nucleotide sequence with at least 90% identity to the nucleotide sequence of the nucleic acids of (a) or (b).
3. The nucleic acid according to item 1 or 2, wherein said nucleic acid is selected from the group consisting of
   (a) a nucleic acid encoding a polypeptide consisting of an amino acid sequence as depicted in SEQ ID NO:1 (CD74-NRG1);
   (b) a nucleic acid consisting of a nucleotide sequence as depicted in SEQ ID NO: 2 (CD74-NRG1); and
   (c) a nucleic acid comprising a nucleotide sequence with at least 90% identity to the nucleotide sequence of the nucleic acids of (a) or (b).
4. The nucleic acid according to any one of items 1 to 3, wherein said nucleic acid is consists of a nucleotide sequence as depicted in SEQ ID NO: 2 (CD74-NRG1).
5. The nucleic acid according to any one of items 1 to 4, wherein said nucleic acid is cDNA.
6. A polypeptide selected from the group consisting of
   (a) a polypeptide comprising the amino acid sequence of SEQ ID NO:1 (CD74-NRG1);
   (b) a polypeptide encoded by the nucleic acid of SEQ ID NO: 2 (CD74-NRG1) or SEQ ID NO. 3 (CD74-NRG1);
   (c) a polypeptide as defined in (a) or (b) wherein one or more amino acids are deleted, inserted, added or substituted;
   (d) a polypeptide encoded by a nucleic acid molecule encoding a polypeptide comprising the amino acid sequence of SEQ ID NO:1 (CD74-NRG1);
   (e) a polypeptide comprising an amino acid sequence encoded by a nucleic acid hybridizing under stringent conditions to the complementary strand of nucleic acid molecules as defined in (b) or (d);
   (f) a polypeptide having at least 70% identity to the polypeptide of any one of (a) to (e); and
   (g) a polypeptide comprising an amino acid sequence encoded by a nucleic acid being degenerate as a result of the genetic code to the nucleotide sequence of a nucleic acid as defined in any one of (b), (d) and (e).

7. The polypeptide according to item 6, wherein said polypeptide is selected from the group consisting of
   (a) a polypeptide comprising the amino acid sequence of SEQ ID NO:1 (CD74-NRG1);
   (b) a polypeptide encoded by the nucleic acid of SEQ ID NO: 2 (CD74-NRG1) or SEQ ID NO: 3 (CD74-NRG1); and
   (c) a polypeptide having at least 90% identity to the polypeptide of (a) or (b).

8. The polypeptide according to item 6 or 7, wherein said polypeptide is selected from the group consisting of
   (a) a polypeptide consisting of the amino acid sequence of SEQ ID NO: 1 (CD74-NRG1);
   (b) a polypeptide encoded by the nucleic acid of SEQ ID NO: 2 (CD74-NRG1) or SEQ ID NO: 3 (CD74-NRG1); and
   (c) a polypeptide having at least 90% identity to the polypeptide of (a) or (b).

9. The polypeptide according to any one of items 6 to 8, wherein said polypeptide consists of the amino acid sequence of SEQ ID NO: 1 (CD74-NRG1).

10. A method for assessing whether a patient suffers from cancer or is prone to suffering from cancer, said method comprising
    determining the presence of a fusion gene in a sample from said patient; and
    assessing that said patient suffers from cancer or is prone to suffering from cancer when said fusion gene is present,
    wherein said fusion gene comprises a nucleic acid encoding an NRG1 protein or a fragment of said protein and wherein said fusion gene comprises a nucleic acid encoding a further protein or a fragment of said protein.

11. The method according to item 10, wherein said further protein is a CD74 protein.

12. The method according to item 10 or 11, wherein said NRG1 protein is selected from the group consisting of
    (a) a protein comprising the amino acid sequence as shown in SEQ ID NO: 4;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 4;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

13. The method according to any one of items 10 to 12, wherein said NRG1 protein is selected from the group consisting of
    (a) a protein comprising the amino acid sequence as shown in SEQ ID NO: 6;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 6;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

14. The method according to any one of items 10 to 13, wherein said CD74 protein is selected from the group consisting of
    (a) a protein comprising the amino acid sequence as shown in SEQ ID NO: 5;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 5;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

15. The method according to any one of items 10 to 14, wherein said CD74 protein is selected from the group consisting of
    (a) a protein comprising the amino acid sequence as shown in SEQ ID NO: 7;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 7;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

16. The method according to any one of items 10 to 15, wherein said fusion gene comprises a nucleic acid encoding an CD74-NRG1 protein or a fragment thereof, wherein said CD74-NRG1 protein is selected from the group consisting of
    (a) a protein comprising the amino acid sequence as shown in SEQ ID NO: 1;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 1;
    (d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

17. A method for assessing whether a patient suffers from cancer or is prone to suffering from cancer, said method comprising
determining the presence of a gene product of a fusion gene in a sample from said patient; and
assessing that said patient suffers from cancer or is prone to suffering from cancer when said gene product is present,
wherein said fusion gene comprises a nucleic acid encoding an NRG1 protein or a fragment of said protein and wherein said fusion gene comprises a nucleic acid encoding a further protein or a fragment of said protein.

18. The method according to item 17, wherein said further protein is a CD74 protein.

19. The method according to item 17 or 18, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

20. The method according to any one of items 17 to 19, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

21. The method according to any one of items 17 to 20, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

22. The method according to any one of items 17 to 21, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

23. The method according to any one of items 17 to 22, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

24. The method according to any one of items 17 to 23, wherein said gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8; (c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d).

25. The method according to any one of items 17 to 24, wherein said gene product comprises a nucleic acid selected from the group consisting of
    (a) a nucleic acid encoding a polypeptide comprising an amino acid sequence as depicted in SEQ ID NO: 7;
    (b) a nucleic acid comprising a nucleotide sequence as depicted in SEQ ID NO: 9;
    (c) a nucleic acid hybridizing under stringent conditions to the complementary strand of the nucleic acid as defined in (a) or (b);
    (d) a nucleic acid comprising a nucleotide sequence with at least 70% identity to the nucleotide sequence of the nucleic acids of any one of (a) to (c); and
    (e) a nucleic acid comprising a nucleotide sequence which is degenerate as a result of the genetic code to the nucleotide sequence of a nucleic acid of any one of (a) to (d).

26. The method according to any one of items 17 to 25, wherein said gene product is selected from the group consisting of
    (a) a nucleic acid encoding a polypeptide comprising an amino acid sequence as depicted in SEQ ID NO: 1 (CD74-NRG1);
    (b) a nucleic acid comprising a nucleotide sequence as depicted in SEQ ID NO: 3 (CD74-NRG1);
    (c) a nucleic acid hybridizing under stringent conditions to the complementary strand of the nucleic acid as defined in (a) or (b);
    (d) a nucleic acid comprising a nucleotide sequence with at least 70% identity to the nucleotide sequence of the nucleic acids of any one of (a) to (c); and
    (e) a nucleic acid comprising a nucleotide sequence which is degenerate as a result of the genetic code to the nucleotide sequence of a nucleic acid of any one of (a) to (d).

27. The method according to any one of items 17 to 23, wherein said gene product comprises a polypeptide selected from the group consisting of
    (a) a polypeptide comprising the amino acid sequence as depicted in SEQ ID NO:6;
    (b) a polypeptide encoded by the nucleic acid of SEQ ID NO:8;
    (c) a polypeptide as defined in (a) or (b) wherein one or more amino acids are deleted, inserted, added or substituted
    (d) a polypeptide encoded by a nucleic acid molecule encoding a polypeptide comprising the amino acid sequence of SEQ ID NO: 6;
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

28. The method according to items 17 to 23 and 27, wherein said gene product comprises a polypeptide selected from the group consisting of
    (a) a polypeptide comprising the amino acid sequence as depicted in SEQ ID NO: 7;
    (b) a polypeptide encoded by the nucleic acid of SEQ ID NO: 9;
    (c) a polypeptide as defined in (a) or (b) wherein one or more amino acids are deleted, inserted, added or substituted
    (d) one or more of a polypeptide encoded by a nucleic acid molecule encoding a polypeptide comprising the amino acid sequence of SEQ ID NO: 7;
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

29. The method according to any one of items 17 to 23, 27 and 28, wherein the polypeptide is selected from the group consisting of
    (a) a polypeptide comprising the amino acid sequence of SEQ ID NO: 1 (CD74-NRG1);
    (b) a polypeptide encoded by the nucleic acid of SEQ ID NO: 3 (CD74-NRG1);
    (c) a polypeptide as defined in (a) or (b) wherein one or more amino acids are deleted, inserted, added or substituted;
    (d) a polypeptide encoded by a nucleic acid molecule encoding a polypeptide comprising the amino acid sequence of SEQ ID NO: 1 (CD74-NRG1);
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

30. A method for assessing whether a patient suffers from cancer or is prone to suffering from cancer, said method comprising
    determining the amount of a gene product of a fusion gene in a sample from said patient; and
    assessing that said patient suffers from cancer or is prone to suffering from cancer when the amount of said gene product is increased in comparison to a control,
    wherein said fusion gene comprises a nucleic acid encoding an NRG1 protein or a fragment of said protein and wherein said fusion gene comprises a nucleic acid encoding a further protein or a fragment of said protein.

31. The method according to item 30, wherein said further protein is a CD74 protein.

32. The method according to item 30 or 31, wherein said NRG1 protein is selected from the group consisting of
    (a) a protein comprising the amino acid sequence as shown in SEQ ID NO: 4;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 4;
    (d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

33. The method according to any one of items 30 to 32, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

34. The method according to any one of items 30 to 33, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

35. The method according to any one of items 30 to 34, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

36. The method according to any one of items 30 to 35, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

37. The method according to any one of items 30 to 36, wherein said gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

38. The method according to any one of items 30 to 37, wherein said gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

39. The method according to any one of items 30 to 38, wherein said gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);

(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

40. The method according to any one of items 30 to 36, wherein said gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

41. The method according to any one of items 30 to 36 and 40, wherein said gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

42. The method according to any one of items 30 to 36, 40 and 41, wherein the polypeptide is selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

43. A method for assessing whether a tumor cell or a cancer cell is responsive to an inhibitor, said method comprising determining the presence of a fusion gene in a sample of a patient,
assessing that said tumor cell or cancer cell is responsive to said inhibitor, when said fusion gene is present,
wherein said fusion gene comprises a nucleic acid encoding an NRG1 protein or a fragment of said protein and wherein said fusion gene comprises a nucleic acid encoding a further protein or a fragment of said protein.

44. The method according to item 43, wherein said further protein is a CD74 protein.

45. The method according to item 43 or 44, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

46. The method according to any one of items 43 to 45, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

47. The method according to any one of items 43 to 46, wherein said CD74 protein is selected from the group consisting of (a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

48. The method according to any one of items 43 to 47, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

49. The method according to any one of items 43 to 48, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

50. A method for assessing whether a tumor cell or a cancer cell is responsive to an inhibitor, said method comprising determining the presence of a gene product of a fusion gene in a sample of a patient,
assessing that said tumor cell or cancer cell is responsive to said inhibitor, when said gene product is present, wherein said fusion gene comprises a nucleic acid encoding an NRG1 protein or a fragment of said protein and wherein said fusion gene comprises a nucleic acid encoding a further protein or a fragment of said protein.

51. The method according to item 40, wherein said further protein is a CD74 protein.

52. The method according to item 50 or 51, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

53. The method according to any one of items 50 to 52, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

54. The method according to any one of items 50 to 53, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

55. The method according to any one of items 50 to 54, wherein said CD74 protein is selected from the group consisting of (a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

56. The method according to any one of items 50 to 55, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

57. The method according to any one of items 50 to 56, wherein said gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

58. The method according to any one of items 50 to 57, wherein said gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

59. The method according to any one of items 50 to 58, wherein said gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

60. The method according to any one of items 50 to 56, wherein said gene product comprises a polypeptide selected from the group consisting of
(a) a polypeptide comprising the amino acid sequence as depicted in SEQ ID NO:6; (b) a polypeptide encoded by the nucleic acid of SEQ ID NO:8;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

61. The method according to any one of items 50 to 56 and 60, wherein said gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and (g) a polypeptide comprising an amino acid sequence encoded by a nucleic acid being degenerate as a result of the genetic code to the nucleotide sequence of a nucleic acid as defined in any one of (b), (d) and (e).

62. The method according to any one of items 50 to 56, 60 and 61, wherein the polypeptide is selected from the group consisting of
    (a) a polypeptide comprising the amino acid sequence of SEQ ID NO: 1 (CD74-NRG1);
    (b) a polypeptide encoded by the nucleic acid of SEQ ID NO: 3 (CD74-NRG1);
    (c) a polypeptide as defined in (a) or (b) wherein one or more amino acids are deleted, inserted, added or substituted;
    (d) a polypeptide encoded by a nucleic acid molecule encoding a polypeptide comprising the amino acid sequence of SEQ ID NO: 1 (CD74-NRG1);
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

63. A method for assessing whether a tumor cell or a cancer cell is responsive to an inhibitor, said method comprising determining the amount of a gene product of a fusion gene in a sample of a patient,
    assessing that said tumor cell or cancer cell is responsive to said inhibitor, when the amount of said gene product is increased in comparison to a control,
    wherein said fusion gene comprises a nucleic acid encoding an NRG1 protein or a fragment of said protein and wherein said fusion gene comprises a nucleic acid encoding a further protein or a fragment of said protein.

64. The method according to item 63, wherein said further protein is a CD74 protein.

65. The method according to item 63 or 64, wherein said NRG1 protein is selected from the group consisting of
    (a) a protein comprising the amino acid sequence as shown in SEQ ID NO: 4;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 4;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

66. The method according to any one of items 63 to 65, wherein said NRG1 protein is selected from the group consisting of
    (a) a protein comprising the amino acid sequence as shown in SEQ ID NO: 6;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 6;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

67. The method according to any one of items 63 to 66, wherein said CD74 protein is selected from the group consisting of
    (a) a protein comprising the amino acid sequence as shown in SEQ ID NO: 5;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 5;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

68. The method according to any one of items 63 to 67, wherein said CD74 protein is selected from the group consisting of
    (a) a protein comprising the amino acid sequence as shown in SEQ ID NO: 7;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 7;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

69. The method according to any one of items 63 to 68, wherein said fusion gene comprises a nucleic acid encoding an CD74-NRG1 protein or a fragment thereof, wherein said CD74-NRG1 protein is selected from the group consisting of
    (a) a protein comprising the amino acid sequence as shown in SEQ ID NO: 1;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 1;
    (d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

70. The method according to any one of items 63 to 69, wherein said gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

71. The method according to any one of items 63 to 70, wherein said gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

72. The method according to any one of items 63 to 71, wherein said gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

73. The method according to any one of items 63 to 69, wherein said gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

74. The method according to any one of items 63 to 69 and 73, wherein said gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

75. The method according to any one of items 63 to 69, 73 and 74, wherein the polypeptide is selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

76. The method according to any one of items 10 to 16 and 43 to 50, wherein said fusion gene is DNA, such as genomic DNA.

77. The method according to item 76, wherein the presence of said DNA is determined by in situ hybridization.

78. The method according to item 77, wherein said in situ hybridization is selected from the group consisting of break-apart in situ hybridization (ba-FISH), fluorescent in situ hybridization (FISH), chromogenic in situ hybridization (CISH) and silver in situ hybridization (SISH).
79. The method according to item 77 or 78, further comprising the steps
   (a) contacting the nucleic acid in the sample with one or more probes;
   (b) incubating the sample under conditions allowing hybridization of the probe to the target sequence; and
   (c) detecting hybridization.
80. The method according to any one of items 17 to 26, 30 to 39, 50 to 59 and 63 to 72, wherein said gene product is mRNA.
81. The method according to item 80, wherein the presence or amount of said mRNA is determined by RealTime PCR, ReverseTranscriptase PCR, Whole Transcriptome Shotgun Sequencing (RNAseq), in situ hybridization or micro-arrays.
82. The method according to item 81, wherein the determination by RealTime PCR or ReverseTranscriptase PCR further comprises the steps
   (i) contacting the nucleic acid in the sample with one or two oligonucleotides:
   (ii) generating an amplification product containing the target sequence.
83. The method according to any one of items 17 to 23, 27 to 29, 30 to 36, 40 to 42, 50 to 56, 60 to 62, 63 to 69 and 73 to 75, wherein said gene product is protein.
84. The method according to item 83, wherein the presence or amount of said protein is determined by immunohistochemistry (IHC), by immunoassay, gel- or blot-based methods, IHC, mass spectrometry, flow cytometry, or FACS.
85. The method according to any one of items 30 to 39, 63 to 72 and 80 to 82, wherein said amount of mRNA is at least 2.5-fold, preferably at least 5-fold increased in comparison to the control; or the method according to any one of items 30 to 36, 40 to 42, 65 to 69, 73 to 75, 83 and 84, wherein said amount of protein is at least 2.5-fold, preferably at least 5-fold increased in comparison to the control.
86. The method according to any one of items 10 to 85, wherein said cancer is solid cancer.
87. The method according to item 86, wherein said solid cancer is lung cancer.
88. The method according to item 87, wherein said lung cancer is lung adenocarcinoma.
89. The method according to item 88, wherein said lung adenocarcinoma is invasive mucinous adenocarcinoma.
90. The method according to any one of items 10 to 89, wherein said patient is a human patient.
91. The method according to any one of items 10 to 90, wherein said sample is a tumor sample.
92. The method according to item 91, wherein said sample is obtained by biopsy.
93. The method according to any one of items 10 to 92, further comprising administering an inhibitor to the patient.
94. The method according to any one of items 43 to 93, wherein said inhibitor is an inhibitor of a member of the ERBB family or an inhibitor of a ligand of a member of the ERBB family, or an inhibitor a component of a pathway activated by the ERBB receptor family, or an inhibitor of NRG1.
95. A method for treating a patient with an inhibitor, said method comprising selecting a cancer patient, wherein a tumor cell or cancer cell of a sample of said patient is determined to have a fusion gene present in said sample, and administering to the patient an effective amount of an inhibitor,
   wherein said fusion gene comprises a nucleic acid encoding an NRG1 protein or a fragment of said protein and wherein said fusion gene comprises a nucleic acid encoding a further protein or a fragment of said protein.
96. The method according to item 95, wherein said further protein is a CD74 protein.
97. The method according to item 95 or 96, wherein said NRG1 protein is selected from the group consisting of
   (a) a protein comprising the amino acid sequence as shown in SEQ ID NO: 4;
   (b) a protein as defined in (a) wherein one or more amino acids are deleted, inserted, added or substituted;
   (c) a polypeptide encoded by a nucleic acid molecule encoding a polypeptide comprising the amino acid sequence as shown in SEQ ID NO: 4;
   (d) a polypeptide comprising an amino acid sequence encoded by a nucleic acid hybridizing under stringent conditions to the complementary strand of nucleic acid molecules as defined in (c);
   (e) a polypeptide having at least 70% identity to the polypeptide of any one of (a) to (d); and
   (f) a polypeptide comprising an amino acid sequence encoded by a nucleic acid being degenerate as a result of the genetic code to the nucleotide sequence of a nucleic acid as defined in (c) or (d).
98. The method according to any one of items 95 to 97, wherein said NRG1 protein is selected from the group consisting of
   (a) a protein comprising the amino acid sequence as shown in SEQ ID NO: 6;
   (b) a protein as defined in (a) wherein one or more amino acids are deleted, inserted, added or substituted;
   (c) a polypeptide encoded by a nucleic acid molecule encoding a polypeptide comprising the amino acid sequence as shown in SEQ ID NO: 6;
   (d) a polypeptide comprising an amino acid sequence encoded by a nucleic acid hybridizing under stringent conditions to the complementary strand of nucleic acid molecules as defined in (c);
   (e) a polypeptide having at least 70% identity to the polypeptide of any one of (a) to (d); and
   (f) a polypeptide comprising an amino acid sequence encoded by a nucleic acid being degenerate as a result of the genetic code to the nucleotide sequence of a nucleic acid as defined in (c) or (d).
99. The method according to any one of items 95 to 98, wherein said CD74 protein is selected from the group consisting of
   (a) a protein comprising the amino acid sequence as shown in SEQ ID NO: 5;
   (b) a protein as defined in (a) wherein one or more amino acids are deleted, inserted, added or substituted;
   (c) a polypeptide encoded by a nucleic acid molecule encoding a polypeptide comprising the amino acid sequence as shown in SEQ ID NO: 5;
   (d) a polypeptide comprising an amino acid sequence encoded by a nucleic acid hybridizing under stringent conditions to the complementary strand of nucleic acid molecules as defined in (c);
   (e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

100. The method according to any one of items 95 to 99, wherein said CD74 protein is selected from the group consisting of
    (a) a protein comprising the amino acid sequence as shown in SEQ ID NO: 7;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 7;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

101. The method according to any one of items 95 to 100, wherein said fusion gene comprises a nucleic acid encoding an CD74-NRG1 protein or a fragment thereof, wherein said CD74-NRG1 protein is selected from the group consisting of
    (a) a protein comprising the amino acid sequence as shown in SEQ ID NO: 1;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 1;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

102. A method for treating a patient with an inhibitor, said method comprising selecting a cancer patient, wherein a tumor cell or cancer cell of a sample of said patient is determined to have a gene product of a fusion gene present in said sample, and administering to the patient an effective amount of an inhibitor,
    wherein said fusion gene comprises a nucleic acid encoding an NRG1 protein or a fragment of said protein and wherein said fusion gene comprises a nucleic acid encoding a further protein or a fragment of said protein.

103. The method according to item 102, wherein said further protein is a CD74 protein.

104. The method according to item 102 or 103, wherein said NRG1 protein is selected from the group consisting of
    (a) a protein comprising the amino acid sequence as shown in SEQ ID NO: 4;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 4;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

105. The method according to any one of items 102 to 104, wherein said NRG1 protein is selected from the group consisting of
    (a) a protein comprising the amino acid sequence as shown in SEQ ID NO: 6;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 6;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

106. The method according to any one of items 102 to 105, wherein said CD74 protein is selected from the group consisting of
    (a) a protein comprising the amino acid sequence as shown in SEQ ID NO: 5;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 5;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

107. The method according to any one of items 102 to 106, wherein said CD74 protein is selected from the group consisting of
    (a) a protein comprising the amino acid sequence as shown in SEQ ID NO: 7;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 7;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

108. The method according to any one of items 102 to 107, wherein said fusion gene comprises a nucleic acid encoding an CD74-NRG1 protein or a fragment thereof, wherein said CD74-NRG1 protein is selected from the group consisting of
    (a) a protein comprising the amino acid sequence as shown in SEQ ID NO: 1;
    (b) a protein as defined in (a) wherein one or more amino acids are deleted, inserted, added or substituted;
    (c) a polypeptide encoded by a nucleic acid molecule encoding a polypeptide comprising the amino acid sequence as shown in SEQ ID NO: 1;
    (d) a polypeptide comprising an amino acid sequence encoded by a nucleic acid hybridizing under stringent conditions to the complementary strand of nucleic acid molecules as defined in (c);
    (e) a polypeptide having at least 70% identity to the polypeptide of any one of (a) to (d); and
    (f) a polypeptide comprising an amino acid sequence encoded by a nucleic acid being degenerate as a result of the genetic code to the nucleotide sequence of a nucleic acid as defined in (c) or (d).

109. The method according to any one of items 102 to 108, wherein said gene product comprises a nucleic acid selected from the group consisting of
    (a) a nucleic acid encoding a polypeptide comprising an amino acid sequence as depicted in SEQ ID NO:6;
    (b) a nucleic acid comprising a nucleotide sequence as depicted in SEQ ID NO:8;
    (c) a nucleic acid hybridizing under stringent conditions to the complementary strand of the nucleic acid as defined in (a) or (b);
    (d) a nucleic acid comprising a nucleotide sequence with at least 70% identity to the nucleotide sequence of the nucleic acids of any one of (a) to (c); and
    (e) a nucleic acid comprising a nucleotide sequence which is degenerate as a result of the genetic code to the nucleotide sequence of a nucleic acid of any one of (a) to (d).

110. The method according to any one of items 102 to 109, wherein said gene product comprises a nucleic acid selected from the group consisting of
    (a) a nucleic acid encoding a polypeptide comprising an amino acid sequence as depicted in SEQ ID NO: 7;
    (b) a nucleic acid comprising a nucleotide sequence as depicted in SEQ ID NO: 9;
    (c) a nucleic acid hybridizing under stringent conditions to the complementary strand of the nucleic acid as defined in (a) or (b);
    (d) a nucleic acid comprising a nucleotide sequence with at least 70% identity to the nucleotide sequence of the nucleic acids of any one of (a) to (c); and
    (e) a nucleic acid comprising a nucleotide sequence which is degenerate as a result of the genetic code to the nucleotide sequence of a nucleic acid of any one of (a) to (d).

111. The method according to any one of items 102 to 110, wherein said gene product is selected from the group consisting of
    (a) a nucleic acid encoding a polypeptide comprising an amino acid sequence as depicted in SEQ ID NO: 1 (CD74-NRG1);
    (b) a nucleic acid comprising a nucleotide sequence as depicted in SEQ ID NO: 3 (CD74-NRG1);
    (c) a nucleic acid hybridizing under stringent conditions to the complementary strand of the nucleic acid as defined in (a) or (b);
    (d) a nucleic acid comprising a nucleotide sequence with at least 70% identity to the nucleotide sequence of the nucleic acids of any one of (a) to (c); and
    (e) a nucleic acid comprising a nucleotide sequence which is degenerate as a result of the genetic code to the nucleotide sequence of a nucleic acid of any one of (a) to (d).

112. The method according to any one of items 102 to 108, wherein said gene product comprises a polypeptide selected from the group consisting of
    (a) a polypeptide comprising the amino acid sequence as depicted in SEQ ID NO:6;
    (b) a polypeptide encoded by the nucleic acid of SEQ ID NO:8;
    (c) a polypeptide as defined in (a) or (b) wherein one or more amino acids are deleted, inserted, added or substituted
    (d) a polypeptide encoded by a nucleic acid molecule encoding a polypeptide comprising the amino acid sequence of SEQ ID NO: 6;
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

113. The method according to any one of items 102 to 108 and 112, wherein said gene product comprises a polypeptide selected from the group consisting of
    (a) a polypeptide comprising the amino acid sequence as depicted in SEQ ID NO: 7;
    (b) a polypeptide encoded by the nucleic acid of SEQ ID NO: 9;
    (c) a polypeptide as defined in (a) or (b) wherein one or more amino acids are deleted, inserted, added or substituted
    (d) one or more of a polypeptide encoded by a nucleic acid molecule encoding a polypeptide comprising the amino acid sequence of SEQ ID NO: 7;
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).

114. The method according to any one of items 102 to 108, 112 and 113, wherein the polypeptide is selected from the group consisting of
    (a) a polypeptide comprising the amino acid sequence of SEQ ID NO: 1 (CD74-NRG1);
    (b) a polypeptide encoded by the nucleic acid of SEQ ID NO: 3 (CD74-NRG1);

(c) a polypeptide as defined in (a) or (b) wherein one or more amino acids are deleted, inserted, added or substituted;

(d) a polypeptide encoded by a nucleic acid molecule encoding a polypeptide comprising the amino acid sequence of SEQ ID NO: 1 (CD74-NRG1);

(e) a polypeptide comprising an amino acid sequence encoded by a nucleic acid hybridizing under stringent conditions to the complementary strand of nucleic acid molecules as defined in (b) or (d);

(f) a polypeptide having at least 70% identity to the polypeptide of any one of (a) to (e); and (g) a polypeptide comprising an amino acid sequence encoded by a nucleic acid being degenerate as a result of the genetic code to the nucleotide sequence of a nucleic acid as defined in any one of (b), (d) and (e).

115. A method for treating a patient with an inhibitor, said method comprising selecting a cancer patient, wherein a tumor cell or cancer cell of a sample of said patient is determined to have an increased amount of a gene product of a fusion gene in said sample in comparison to a control, and administering to the patient an effective amount of an inhibitor, wherein said fusion gene comprises a nucleic acid encoding an NRG1 protein or a fragment of said protein and wherein said fusion gene comprises a nucleic acid encoding a further protein or a fragment of said protein.

116. The method according to item 115, wherein said further protein is a CD74 protein.

117. The method according to item 115 or 116, wherein said NRG1 protein is selected from the group consisting of (a) a protein comprising the amino acid sequence as shown in SEQ ID NO: 4;

(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 4;

(d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

118. The method according to any one of items 115 to 117, wherein said NRG1 protein is selected from the group consisting of (a) a protein comprising the amino acid sequence as shown in SEQ ID NO: 6;

(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 6;

(d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

119. The method according to any one of items 115 to 118, wherein said CD74 protein is selected from the group consisting of (a) a protein comprising the amino acid sequence as shown in SEQ ID NO: 5;

(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 5;

(d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

120. The method according to any one of items 115 to 119, wherein said CD74 protein is selected from the group consisting of (a) a protein comprising the amino acid sequence as shown in SEQ ID NO: 7;

(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 7;

(d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

121. The method according to any one of items 115 to 120, wherein said fusion gene comprises a nucleic acid encoding an CD74-NRG1 protein or a fragment thereof, wherein said CD74-NRG1 protein is selected from the group consisting of (a) a protein comprising the amino acid sequence as shown in SEQ ID NO: 1;

(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 1;

(d) a polypeptide comprising an amino acid sequence encoded by a nucleic acid hybridizing under stringent conditions to the complementary strand of nucleic acid molecules as defined in (c);

(e) a polypeptide having at least 70% identity to the polypeptide of any one of (a) to (d); and (f) a polypeptide comprising an amino acid sequence encoded by a nucleic acid being degenerate as a result of the genetic code to the nucleotide sequence of a nucleic acid as defined in (c) or (d).

122. The method according to any one of items 115 to 121, wherein said gene product comprises a nucleic acid selected from the group consisting of (a) a nucleic acid encoding a polypeptide comprising an amino acid sequence as depicted in SEQ ID NO:6;
(b) a nucleic acid comprising a nucleotide sequence as depicted in SEQ ID NO:8; (c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

123. The method according to any one of items 115 to 122, wherein said gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

124. The method according to any one of items 115 to 123, wherein said gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

125. The method according to any one of items 115 to 121, wherein said gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

126. The method according to any one of items 115 to 121 and 125, wherein said gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

127. The method according to any one of items 115 to 121, 125 and 126, wherein the polypeptide is selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

128. An inhibitor for use in treating a cancer patient, wherein a tumor cell or cancer cell of a sample of said patient has a fusion gene present in said sample,
wherein said fusion gene comprises a nucleic acid encoding an NRG1 protein or a fragment of said protein and wherein said fusion gene comprises a nucleic acid encoding a further protein or a fragment of said protein.

129. The inhibitor according to item 128, wherein said further protein is a CD74 protein.

130. The inhibitor according to item 128 or 129, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

131. The inhibitor according to any one of items 128 to 130, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

132. The inhibitor according to any one of items 128 to 131, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

133. The inhibitor according to any one of items 128 to 132, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

134. The inhibitor according to any one of items 128 to 133, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

135. An inhibitor for use in treating a cancer patient, wherein a tumor cell or cancer cell of a sample of said patient has a gene product of a fusion gene present in said sample, wherein said fusion gene comprises a nucleic acid encoding an NRG1 protein or a fragment of said protein and wherein said fusion gene comprises a nucleic acid encoding a further protein or a fragment of said protein.

136. The inhibitor according to item 135, wherein said further protein is a CD74 protein.

137. The inhibitor according to item 135 or 136, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

138. The inhibitor according to any one of items 135 to 137, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;

(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

139. The inhibitor according to any one of items 135 to 138, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

140. The inhibitor according to any one of items 135 to 139, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

141. The inhibitor according to any one of items 135 to 140, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

142. The inhibitor according to any one of items 135 to 141 wherein said gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

143. The inhibitor according to any one of items 135 to 142, wherein said gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

144. The inhibitor according to any one of items 135 to 143, wherein said gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

145. The inhibitor according to any one of items 135 to 141, wherein said gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8;

(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

146. The inhibitor according to any one of items 135 to 141 and 146, wherein said gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

147. The inhibitor according to any one of items 135 to 141, 145 and 146, wherein the polypeptide is selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

148. An inhibitor for use in treating a cancer patient, wherein a tumor cell or cancer cell of a sample of said patient has an increased amount of a gene product of a fusion gene in comparison to a control in said sample in said sample, wherein said fusion gene comprises a nucleic acid encoding an NRG1 protein or a fragment of said protein and wherein said fusion gene comprises a nucleic acid encoding a further protein or a fragment of said protein.

149. The inhibitor according to item 148, wherein said further protein is a CD74 protein.

150. The inhibitor according to item 148 or 149, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

151. The inhibitor according to any one of items 148 to 150, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

152. The inhibitor according to any one of items 148 to 151, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

153. The inhibitor according to any one of items 148 to 152, wherein said CD74 protein is selected from the group consisting of
   (a) a protein comprising the amino acid sequence as shown in SEQ ID NO: 7;
   (b) a protein as defined in (a) wherein one or more amino acids are deleted, inserted, added or substituted;
   (c) a polypeptide encoded by a nucleic acid molecule encoding a polypeptide comprising the amino acid sequence as shown in SEQ ID NO: 7;
   (d) a polypeptide comprising an amino acid sequence encoded by a nucleic acid hybridizing under stringent conditions to the complementary strand of nucleic acid molecules as defined in (c);
   (e) a polypeptide having at least 70% identity to the polypeptide of any one of (a) to (d); and
   (f) a polypeptide comprising an amino acid sequence encoded by a nucleic acid being degenerate as a result of the genetic code to the nucleotide sequence of a nucleic acid as defined in (c) or (d).

154. The inhibitor according to any one of items 148 to 153, wherein said fusion gene comprises a nucleic acid encoding an CD74-NRG1 protein or a fragment thereof, wherein said CD74-NRG1 protein is selected from the group consisting of
   (a) a protein comprising the amino acid sequence as shown in SEQ ID NO: 1;
   (b) a protein as defined in (a) wherein one or more amino acids are deleted, inserted, added or substituted;
   (c) a polypeptide encoded by a nucleic acid molecule encoding a polypeptide comprising the amino acid sequence as shown in SEQ ID NO: 1;
   (d) a polypeptide comprising an amino acid sequence encoded by a nucleic acid hybridizing under stringent conditions to the complementary strand of nucleic acid molecules as defined in (c);
   (e) a polypeptide having at least 70% identity to the polypeptide of any one of (a) to (d); and
   (f) a polypeptide comprising an amino acid sequence encoded by a nucleic acid being degenerate as a result of the genetic code to the nucleotide sequence of a nucleic acid as defined in (c) or (d).

155. The inhibitor according to any one of items 148 to 154, wherein said gene product comprises a nucleic acid selected from the group consisting of
   (a) a nucleic acid encoding a polypeptide comprising an amino acid sequence as depicted in SEQ ID NO:6;
   (b) a nucleic acid comprising a nucleotide sequence as depicted in SEQ ID NO:8;
   (c) a nucleic acid hybridizing under stringent conditions to the complementary strand of the nucleic acid as defined in (a) or (b);
   (d) a nucleic acid comprising a nucleotide sequence with at least 70% identity to the nucleotide sequence of the nucleic acids of any one of (a) to (c); and
   (e) a nucleic acid comprising a nucleotide sequence which is degenerate as a result of the genetic code to the nucleotide sequence of a nucleic acid of any one of (a) to (d).

156. The inhibitor according to any one of items 148 to 155, wherein said gene product comprises a nucleic acid selected from the group consisting of
   (a) a nucleic acid encoding a polypeptide comprising an amino acid sequence as depicted in SEQ ID NO: 7;
   (b) a nucleic acid comprising a nucleotide sequence as depicted in SEQ ID NO: 9;
   (c) a nucleic acid hybridizing under stringent conditions to the complementary strand of the nucleic acid as defined in (a) or (b);
   (d) a nucleic acid comprising a nucleotide sequence with at least 70% identity to the nucleotide sequence of the nucleic acids of any one of (a) to (c); and
   (e) a nucleic acid comprising a nucleotide sequence which is degenerate as a result of the genetic code to the nucleotide sequence of a nucleic acid of any one of (a) to (d).

157. The inhibitor according to any one of items 148 to 156, wherein said gene product is selected from the group consisting of
   (a) a nucleic acid encoding a polypeptide comprising an amino acid sequence as depicted in SEQ ID NO: 1 (CD74-NRG1);
   (b) a nucleic acid comprising a nucleotide sequence as depicted in SEQ ID NO: 3 (CD74-NRG1);
   (c) a nucleic acid hybridizing under stringent conditions to the complementary strand of the nucleic acid as defined in (a) or (b);
   (d) a nucleic acid comprising a nucleotide sequence with at least 70% identity to the nucleotide sequence of the nucleic acids of any one of (a) to (c); and
   (e) a nucleic acid comprising a nucleotide sequence which is degenerate as a result of the genetic code to the nucleotide sequence of a nucleic acid of any one of (a) to (d).

158. The inhibitor according to any one of items 148 to 154, wherein said gene product comprises a polypeptide selected from the group consisting of
   (a) a polypeptide comprising the amino acid sequence as depicted in SEQ ID NO:6;
   (b) a polypeptide encoded by the nucleic acid of SEQ ID NO:8;
   (c) a polypeptide as defined in (a) or (b) wherein one or more amino acids are deleted, inserted, added or substituted
   (d) a polypeptide encoded by a nucleic acid molecule encoding a polypeptide comprising the amino acid sequence of SEQ ID NO: 6;
   (e) a polypeptide comprising an amino acid sequence encoded by a nucleic acid hybridizing under stringent conditions to the complementary strand of nucleic acid molecules as defined in (b) or (d);
   (f) a polypeptide having at least 70% identity to the polypeptide of any one of (a) to (e); and
   (g) a polypeptide comprising an amino acid sequence encoded by a nucleic acid being degenerate as a result of the genetic code to the nucleotide sequence of a nucleic acid as defined in any one of (b), (d) and (e).

159. The inhibitor according to any one of items 148 to 154 and 158, wherein said gene product comprises a polypeptide selected from the group consisting of
   (a) a polypeptide comprising the amino acid sequence as depicted in SEQ ID NO: 7;
   (b) a polypeptide encoded by the nucleic acid of SEQ ID NO: 9;
   (c) a polypeptide as defined in (a) or (b) wherein one or more amino acids are deleted, inserted, added or substituted
   (d) one or more of a polypeptide encoded by a nucleic acid molecule encoding a polypeptide comprising the amino acid sequence of SEQ ID NO: 7;
   (e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

160. The inhibitor according to any one of items 148 to 154, 158 and 159, wherein the polypeptide is selected from the group consisting of
    (a) a polypeptide comprising the amino acid sequence of SEQ ID NO: 1 (CD74-NRG1);
    (b) a polypeptide encoded by the nucleic acid of SEQ ID NO: 3 (CD74-NRG1);
    (c) a polypeptide as defined in (a) or (b) wherein one or more amino acids are deleted, inserted, added or substituted;
    (d) a polypeptide encoded by a nucleic acid molecule encoding a polypeptide comprising the amino acid sequence of SEQ ID NO: 1 (CD74-NRG1);
    (e) a polypeptide comprising an amino acid sequence encoded by a nucleic acid hybridizing under stringent conditions to the complementary strand of nucleic acid molecules as defined in (b) or (d);
    (f) a polypeptide having at least 70% identity to the polypeptide of any one of (a) to (e); and
    (g) a polypeptide comprising an amino acid sequence encoded by a nucleic acid being degenerate as a result of the genetic code to the nucleotide sequence of a nucleic acid as defined in any one of (b), (d) and (e).
161. The method according to any one of items 95 to 101; or the inhibitor according to item 102 to 134, wherein said fusion gene is DNA, such as genomic DNA.
162. The method according to item 161, or the inhibitor according to item 161, wherein the presence of said DNA is determined by in situ hybridization.
163. The method according to item 162, or the inhibitor according to item 162, wherein said in situ hybridization is selected from the group consisting of break-apart in situ hybridization (ba-FISH), fluorescent in situ hybridization (FISH), chromogenic in situ hybridization (CISH) and silver in situ hybridization (SISH).
164. The method according to item 161 or 162, or the inhibitor according to item 161 or 162, wherein said determining the presence of said DNA further comprises
    (a) contacting the nucleic acid in the sample with one or more probes;
    (b) incubating the sample under conditions allowing hybridization of the probe to the target sequence; and
    (c) detecting hybridization.
165. The method according to any one of items 102 to 111 and 115 to 124; or the inhibitor according to item 135 to 144 and 148 to 157, wherein said gene product is mRNA.
166. The method according to item 165, or the inhibitor according to item 165, wherein the presence or amount of said mRNA is determined by RealTime PCR, Reverse-Transcriptase PCR, Whole Transcriptome Shotgun Sequencing (RNAseq), in situ hybridization or microarrays.
167. The method according to item 166, or the inhibitor according to item 166, wherein the determination by RealTime PCR or ReverseTranscriptase PCR further comprises the steps
    (i) contacting the nucleic acid in the sample with one or two oligonucleotides;
    (ii) generating an amplification product containing the target sequence.
168. The method according to any one of items 102-108, 112 to 114, 115 to 121, 125 to 127, or the inhibitor according to any one of items 135 to 141, 145 to 147, 148 to 154 and 158 to 160, wherein said gene product is protein.
169. The method according to item 168, or the inhibitor of item 168, wherein the presence or amount of said protein is determined by immunohistochemistry (IHC), by immunoassay, gel- or blot-based methods, IHC, mass spectrometry, flow cytometry, or FACS.
170. The method according to any one of items 115 to 124 and 165 to 167, or the inhibitor according to any one of items 148 to 157 and 165 to 167, wherein said amount of mRNA is at least 2.5-fold, preferably at least 5-fold increased in comparison to the control; or the method according to any one of items 115 to 121, 125 to 127, 168 and 169, or the inhibitor according to any one of items 148 to 154, 158 to 160, 168 and 169, wherein said amount of protein is at least 2.5-fold, preferably at least 5-fold increased in comparison to the control.
171. The method according to any one of items 95 to 127 and 161 to 170, or the inhibitor according to any one of items 128 to 170, wherein said cancer is solid cancer.
172. The method according to item 171, or the inhibitor according to item 171, wherein said solid cancer is lung cancer.
173. The method according to item 172, or the inhibitor according to item 172, wherein said lung cancer is lung adenocarcinoma.
174. The method according to item 173, or the inhibitor according to item 173, wherein said lung adenocarcinoma is invasive mucinous adenocarcinoma.
175. The method according to any one of items 95 to 127 and 161 to 174; or the inhibitor according to any one of items 128 to 174, wherein said patient is a human patient.
176. The method according to any one of items 95 to 127 and 161 to 175, or the inhibitor according to any one of items 128 to 175, wherein said sample is a tumor sample.
177. The method according to item 176, or the inhibitor according to item 176, wherein said sample is obtained by biopsy.
178. The method according to any one of items 95 to 127 and 161 to 177, or the inhibitor according to any one of items 128 to 177, wherein said inhibitor is an inhibitor of a member of the ERBB family or an inhibitor of a ligand of a member of the ERBB family.

Further, the present invention relates to the following items

1. A fusion gene comprising a nucleic acid encoding an NRG1 protein or a fragment of said protein and comprising a nucleic acid encoding a further protein or a fragment of said protein.
2. The fusion gene according to item 1, wherein said further protein is a CD74 protein or an MTSS1 protein.
3. The fusion gene according to item 2, wherein said fusion gene comprises a nucleic acid encoding an NRG1 protein or a fragment of said protein and wherein said fusion gene comprises a nucleic acid encoding a CD74 protein or a fragment of said protein, wherein said NRG1 protein is selected from the group consisting of
    (a) a protein comprising the amino acid sequence as shown in SEQ ID NO: 6;
    (b) a protein as defined in (a) wherein one or more amino acids are deleted, inserted, added or substituted;

(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

4. The fusion gene according to items 2 or 3, wherein said fusion gene comprises a nucleic acid encoding an NRG1 protein or a fragment of said protein and wherein said fusion gene comprises a nucleic acid encoding a CD74 protein or a fragment of said protein, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

5. The fusion gene according to any one of items 2 to 4, wherein said fusion gene comprises a nucleic acid encoding an CD74-NRG1 protein or a fragment thereof, wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

6. The fusion gene according to item 2, wherein said fusion gene comprises a nucleic acid encoding an NRG1 protein or a fragment of said protein and wherein said fusion gene comprises a nucleic acid encoding an MTSS1 protein or a fragment of said protein, wherein said NRG1 protein is selected from the group consisting of
(a) a protein comprising the amino acid sequence as shown in SEQ ID NO: 13;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 13;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

7. The fusion gene according to item 2 or 6, wherein said fusion gene comprises a nucleic acid encoding an NRG1 protein or a fragment of said protein and wherein said fusion gene comprises a nucleic acid encoding an MTSS1 protein or a fragment of said protein, wherein said MTSS1 protein is selected from the group consisting of
(a) a protein comprising the amino acid sequence as shown in SEQ ID NO: 14;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 14;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

8. The fusion gene according to any one of items 2, 6 and 7, wherein said fusion gene comprises a nucleic acid encoding an MTSS1-NRG1 protein or a fragment thereof, wherein said MTSS1-NRG1 protein is selected from the group consisting of
(a) a protein comprising the amino acid sequence as shown in SEQ ID NO: 10;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 10;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(f) a polypeptide comprising an amino acid sequence encoded by a nucleic acid being degenerate as a result of the genetic code to the nucleotide sequence of a nucleic acid as defined in (c) or (d).

9. A polypeptide selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);

(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

10. A polypeptide selected from the group consisting of
(a) a polypeptide comprising the amino acid sequence of SEQ ID NO: 10 (MTSS1-NRG1);
(b) a polypeptide encoded by the nucleic acid of SEQ ID NO: 12 (MTSS1-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 10 (MTSS1-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

11. A method for assessing whether a patient suffers from lung cancer or is prone to suffering from lung cancer, said method comprising
determining the presence of a fusion gene or of a gene product of a fusion gene in a sample from said patient; and
assessing that said patient suffers from lung cancer or is prone to suffering from lung cancer when said fusion gene is present or when said gene product of a fusion gene is present,
wherein said fusion gene comprises a nucleic acid encoding an NRG1 protein or a fragment of said protein and wherein said fusion gene comprises a nucleic acid encoding a further protein or a fragment of said protein.

12. A method for assessing whether a lung tumor cell or a lung cancer cell is responsive to an inhibitor, said method comprising
determining the presence of a fusion gene or of a gene product of a fusion gene in a sample of a patient,
assessing that said lung tumor cell or lung cancer cell is responsive to said inhibitor, when said fusion gene is present or when said gene product of a fusion gene is present, wherein said fusion gene comprises a nucleic acid encoding an NRG1 protein or a fragment of said protein and wherein said fusion gene comprises a nucleic acid encoding a further protein or a fragment of said protein,
wherein said inhibitor is an inhibitor of a member of the ERBB family or an inhibitor of a ligand of a member of the ERBB family, or an inhibitor of a component of a pathway activated by the ERBB receptor family, or an inhibitor of NRG1.

13. An inhibitor for use in treating a lung cancer patient, wherein a lung tumor cell or lung cancer cell of a sample of said patient has a fusion gene or a gene product of a fusion gene present in said sample,
wherein said fusion gene comprises a nucleic acid encoding an NRG1 protein or a fragment of said protein and wherein said fusion gene comprises a nucleic acid encoding a further protein or a fragment of said protein,
wherein said inhibitor is an inhibitor of a member of the ERBB family or an inhibitor of a ligand of a member of the ERBB family.

14. The method according to item 11 or 12, or the inhibitor of item 13,
wherein said fusion gene comprises a gene of NRG1 having a nucleotide sequence as shown in NCBI Reference Sequence: NG_012005.1 (Gene ID: 3084; gi: 236459116) or a fragment thereof and wherein said fusion gene comprises a gene of CD74 having a nucleotide sequence as shown in NCBI Reference Sequence: NG_029730.1 (Gene ID: 972; gi:343488507) or a fragment thereof; or
wherein said fusion gene comprises a gene of NRG1 having a nucleotide sequence as shown in NCBI Reference Sequence NG_012005.1 (Gene ID: 3084; gi: 236459116) or a fragment thereof; and wherein said fusion gene comprises a gene of MTSS1 having a nucleotide sequence as shown in NCBI Reference Sequence NC_000008.10 (Gene ID: 9788; gi:224589820) or a fragment thereof 15. The method according to any one of items 11, 12 and 14, or the inhibitor of item 13 or 14, wherein said NRG1 protein is defined in item 3 and/or wherein said further protein is a CD74 protein as defined in item 4.

16. The method according to any one of items 11, 12 and 14 and 15; or the inhibitor according to any one of items 13 to 15, wherein said fusion gene comprises a nucleic acid encoding an CD74-NRG1 protein or a fragment thereof as defined in item 5.

17. The method according to any one of items 11, 12 and 14; or the inhibitor according to item 13 or 14 wherein said NRG1 protein is defined in item 6 and/or wherein said further protein is an MTSS1 protein as defined in item 7.

18. The method according to any one of items 11, 12, 14 and 17; or the inhibitor according to item 13, 14 and 17, wherein said fusion gene comprises a nucleic acid encoding an MTSS1-NRG1 protein or a fragment thereof as defined in item 8.

19. The method according to any one of items 11, 12, and 14 to 18; or the inhibitor according to any one of items 13 to 18, wherein said lung cancer is lung adenocarcinoma, in particular invasive mucinous adenocarcinoma; or wherein said lung cancer is small cell lung cancer.

The invention is described in more detail in the following.
The present invention relates to a method for assessing whether a patient suffers from cancer or is prone to suffering from cancer, said method comprising
determining the presence of a fusion gene in a sample from said patient; and
assessing that said patient suffers from cancer or is prone to suffering from cancer when said fusion gene is present,
wherein said fusion gene comprises a nucleic acid encoding an NRG1 protein or a fragment of said protein and wherein said fusion gene comprises a nucleic acid encoding a further protein or a fragment of said protein. Preferably, said further protein is a CD74 protein.

The term "patient suffering from cancer" as used herein refers to a cancer patient, i.e. a tumor/cancer is present or was present.

If the tumor/cancer is present, the tumor/cancer may, for example, not yet have been positively or reliably diagnosed by conventional diagnostic methods. Alternatively, the patient may be suspected of suffering from cancer and a reliable diagnosis is needed. In this context, the present invention is useful in providing a reliable diagnosis whether the tumor/cancer is present.

If the tumor/cancer was present, the tumor may have been resected by conventional therapy like surgical methods (e.g. neoadjuvant or adjuvant therapy) and/or treated by chemotherapy. In this context, the present invention is useful in providing a reliable diagnosis that the tumor/cancer is no longer present and/or that metastates do not exist. For the purpose of the present invention, it is preferred that the "patient suffers from cancer".

The term "patient prone to suffering from cancer" refers to a patient at risk of developing a cancer. Such patients have, for example, inherited risk factors. Here, the present invention can provide an early diagnosis that can help to initiate appropriate therapy so as to avoid the development of a cancer/tumor.

Preferably, the diagnostic methods provided herein are in vitro methods. Such in vitro diagnostic methods are there herein provided "methods for assessing whether a patient suffers from cancer or is prone to suffering from cancer" or "methods for assessing whether a tumor cell or cancer cell is responsive to an inhibitor".

The term "fusion gene" as used herein refers generally to a nucleic acid encoding an NRG1 protein or a fragment of said protein wherein the fusion gene further comprises a nucleic acid encoding a further protein or a fragment of said protein, preferably a CD74 protein. It is preferred herein that the "fusion gene" has the order 5'-"nucleic acid encoding a further protein or a fragment of said protein"-nucleic acid encoding an NRG1 protein or a fragment of said protein"-3'. For example, a "fusion gene" has the order 5'-"nucleic acid encoding a CD74 protein or a fragment of said protein"-nucleic acid encoding an NRG1 protein or a fragment of said protein"-3'. For example, a "fusion gene" has the order 5'-"nucleic acid encoding a MTSS1 protein or a fragment of said protein"-nucleic acid encoding an NRG1 protein or a fragment of said protein"-3'.

A "fusion gene" to be used herein can be the result of a "genomic translocation/rearrangement". A "genomic translocation/rearrangement" is a structural variation resulting from a change in the position of a chromosomal segment within a genome. Translocations can happen within the same chromosome (intra-chromosomal) or between two different chromosomes (inter-chromosomal). The rearrangement sometimes causes the fusion of one or more genes (fusion gene). This fusion then results a misallocation and may cause altered expression, and/or total or partial disruption of one or more of the genes comprised in said fusion gene. The rearrangement that fuses two genes resulting in the production of an active protein is termed "activating fusion gene". Herein preferred are activating fusion genes. Hence, an activating fusion gene codes for a "fusion protein" with an activity, such as a new or altered (particularly increased) activity. In contrast, a rearrangement may also produce fusion gene that does not code for a functional protein but leads to a loss of function of proteins of the one or more genes of the fusion gene. Such a fusion gene is also referred to herein as "inactivating fusion gene".

Exemplary "fusion proteins" are shown in SEQ ID NO. 1 and 10 and are described in more detail further below. It is preferred herein that the "fusion protein" has the order N-terminus-"further protein or a fragment of said protein"-NRG1 protein or a fragment of said protein"-C-terminus'. For example, a "fusion protein" has the order N-terminus-"CD74 protein or a fragment of said protein"-NRG1 protein or a fragment of said protein"-C-terminus'. For example, a "fusion protein" has the order N-terminus-"MTSS1 protein or a fragment of said protein"-NRG1 protein or a fragment of said protein"-C-terminus'.

In accordance with the above and without deferring from the gist of the present invention, the "fusion gene" provided herein and to be used herein relates to a fusion of a gene of NRG1 (or of a fragment thereof) and of a further gene, preferably a gene of CD74 (or of a fragment thereof). The nucleotide sequences of a gene of NRG1 and of a further gene, preferably a gene of CD74, are well known and can be deduced from databases like NCBI or EMBL. For example, the nucleotide sequence of the NRG1 gene can be deduced under accession number ID:3084 or NG_012005.1 or gi: 236459116:4553-1130291 from NCBI. Particularly, the nucleotide sequence of the NRG1 gene can be deduced under accession number gi: 236459116 from NCBI. The nucleotide sequence of the CD74 gene can be deduced under accession number ID:972 or NG_029730.1 or gi:343488507:5001-16300 from NCBI. Particularly, the nucleotide sequence of the CD74 gene can be deduced under accession number gi:343488507 from NCBI.

In accordance with the above, the fusion gene provided and to be used herein can comprise a gene of NRG1 or a fragment thereof; and a gene of CD74 or a fragment thereof.

The fusion gene provided and to be used herein can comprise a gene of NRG1 having a nucleotide sequence as shown in NCBI Reference Sequence: NG_012005.1 (Gene ID: 3084; gi: 236459116) or a fragment thereof; and a gene of CD74 having a nucleotide sequence as shown in NCBI Reference Sequence: NG_029730.1 (Gene ID: 972; gi:343488507) or a fragment thereof.

The fusion gene provided and to be used herein can comprise a gene of NRG1 having a nucleotide sequence as shown in NCBI Reference Sequence gi: 236459116 or a fragment thereof; and a gene of CD74 having a nucleotide sequence as shown in NCBI Reference Sequence: gi:343488507 or a fragment thereof.

The terms "gene of NRG1"/"NRG1 gene" and "gene of CD74"/"CD74 gene" also relates to variants of the specific NRG1 genes and/or CD74 genes disclosed herein or deducible from the corresponding databases, like NCBI. Such variants are, for example, genetic variants, and encompass, for example, sequences hybridizing to the specific nucleic acid sequences or having, e.g. 70% identity to the nucleotide sequence of the "gene of NRG1"/"NRG1 gene" and "gene of CD74"/"CD74 gene", respectively, or of a fragment thereof.

For example, the term "gene of NRG1"/"NRG1 gene" refers to
(a) a nucleic acid encoding an NRG1 protein;
(b) a nucleic acid comprising a nucleotide sequence as depicted in NCBI Reference Sequence: NG_012005.1 (Gene ID: 3084; gi: 236459116);
(c) a nucleic acid hybridizing under stringent conditions to the complementary strand of the nucleic acid as defined in (a) or (b);

(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

For example, the term "gene of CD74"/"CD74 gene" refers to
(a) a nucleic acid encoding an CD74 protein;
(b) a nucleic acid comprising a nucleotide sequence as depicted in NCBI Reference Sequence: NG_029730.1 (Gene ID: 972; gi:343488507);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene of NRG1 (or a fragment thereof) encodes an NRG1 protein (or a fragment thereof). Currently, several variant isoforms of NRG1 proteins are known. The exemplary respective amino acid sequences of said variant isoforms can be deduced under the following accession numbers from NCBI: NM_001159995.1, NM_001159996.1, NM_001159999.1, NM_001160001.1, NM_001160002.1, NM_001160004.1, NM_001160005.1, NM_001160007.1, NM_001160008.1, NM_004495.3, NM_013956.3, NM_013957.3, NM_013958.3, NM_013959.3, NM_013960.3, NM_013962.2 and, NM_013964.3. The amino acid sequences of said variant isoforms are encompassed herein and incorporated by reference. Accordingly, the term "gene of NRG1" refers to a gene encoding any one of the known (or yet to be identified) NRG1 isoform variants/proteins. Likewise, the term "a fragment of the gene of NRG1" refers to a fragment of said gene of NRG1 encoding a fragment of any one of the known (or yet to be identified) NRG1 isoform variants.

Likewise, the gene of a further fusion partner (like CD74) (or a fragment thereof) encodes a further protein (or a fragment thereof), like a CD74 protein (or a fragment thereof). Several variant isoforms of e.g. CD74 proteins are known. The respective exemplary amino acid sequences of said variant isoforms can be deduced under the following accession numbers from NCBI: NM_001025158.2, NM_001025159.2 and, NM_004355.3. The amino acid sequences of said variant isoforms are encompassed herein and incorporated by reference. Accordingly, the term "gene of a further fusion partner" (like "gene of CD74") refers to a gene encoding any one of the known (or yet to be identified) isoform variants of further fusion partners, like CD74 isoform variants. Likewise, the term "a fragment of the gene of CD74" refers to a fragment of said gene of further fusion partners (like CD74) encoding a fragment of any one of the known (or yet to be identified) isoform variants, like CD74 isoform variants.

In accordance with the above, the term "fusion gene comprising a nucleic acid encoding an NRG1 protein or a fragment of said protein and comprising a nucleic acid encoding a further protein" can relate to a "fusion gene comprising a gene encoding a NRG1 variant isoform or a fragment thereof and comprising a gene encoding a variant isoform of further fusion partners or a fragment thereof".

Particularly, the term "fusion gene comprising a nucleic acid encoding an NRG1 protein or a fragment of said protein and comprising a nucleic acid encoding an CD74 protein" relates to a "fusion gene comprising a gene encoding an NRG1 variant isoform or a fragment thereof and comprising a gene encoding a CD74 variant isoform or a fragment thereof".

For the purpose of the present invention, the fusion gene provided and to be used herein comprises a nucleic acid encoding an NRG1 protein or a fragment of said protein and comprises a nucleic acid encoding a further protein or a fragment of said protein. Preferably, said further protein is a CD74 protein.

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;

(b) a polypeptide having at least 70% identity to the polypeptide of any one of (a).

The fusion gene provided and to be used herein comprises a nucleic acid encoding a further protein or a fragment of said protein, preferably CD74 protein.

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 5; and
(b) a polypeptide having at least 70% identity to the polypeptide of any one of (a).

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the fusion gene comprises a nucleic acid encoding a CD74 protein or a fragment of said CD74 protein, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of any one of (a);
and
the fusion gene comprises a nucleic acid encoding a CD74 protein or a fragment of said CD74 protein, wherein said CD74 protein is selected from the group consisting of
(a) a protein comprising the amino acid sequence as shown in SEQ ID NO: 5; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;

(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a polypeptide having at least 70% identity to the polypeptide of any one of (a);
and
the fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7; and
(b) a polypeptide having at least 70% identity to the polypeptide of any one of (a).

In a preferred embodiment, the fusion gene comprises a nucleic acid encoding an CD74-NRG1 protein or a fragment thereof,
wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

In a very preferred embodiment, the fusion gene comprises a nucleic acid encoding an CD74-NRG1 protein or a fragment thereof,
wherein said CD74-NRG1 protein is selected from the group consisting of
(a) a protein comprising the amino acid sequence as shown in SEQ ID NO: 1;
(b) a polypeptide having at least 70% identity to the polypeptide of any one of (a).

The present invention relates to a method for assessing whether a patient suffers from cancer or is prone to suffering from cancer, said method comprising
determining the presence of a fusion gene in a sample from said patient; and
assessing that said patient suffers from cancer or is prone to suffering from cancer when said fusion gene is present,
wherein said fusion gene comprises a nucleic acid encoding an NRG1 protein or a fragment of said protein and wherein said fusion gene comprises a nucleic acid encoding a further protein or a fragment of said protein. Preferably, said further protein is a CD74 protein.

Preferably, the diagnostic methods provided herein are in vitro methods. Such in vitro diagnostic methods are there herein provided "methods for assessing whether a patient suffers from cancer or is prone to suffering from cancer" or "methods for assessing whether a tumor cell or cancer cell is responsive to an inhibitor".

The term "fusion gene" as used herein refers generally to a nucleic acid encoding an NRG1 protein or a fragment of said protein wherein the fusion gene further comprises a nucleic acid encoding a further protein or a fragment of said protein, preferably a CD74 protein.

A "fusion gene" to be used herein can be the result of a "genomic translocation/rearrangement". A "genomic translocation/rearrangement" is a structural variation resulting from a change in the position of a chromosomal segment within a genome. Translocations can happen within the same chromosome (intra-chromosomal) or between two different chromosomes (inter-chromosomal). The rearrangement sometimes causes the fusion of one or more genes (fusion gene). This fusion then results a misallocation and may cause altered expression, and/or total or partial disruption of one or more of the genes comprised in said fusion gene. The rearrangement that fuses two genes resulting in the production of an active protein is termed "activating fusion gene". Herein preferred are activating fusion genes.

Hence, an activating fusion gene codes for a "fusion protein" with an activity, such as a new or altered (particularly increased) activity. In contrast, a rearrangement may also produce fusion gene that does not code for a functional protein but leads to a loss of function of proteins of the one or more genes of the fusion gene. Such a fusion gene is also referred to herein as "inactivating fusion gene".

In accordance with the above and without deferring from the gist of the present invention, the "fusion gene" provided herein and to be used herein relates to a fusion of a gene of NRG1 (or of a fragment thereof) and of a further gene, preferably a gene of CD74 (or of a fragment thereof). The nucleotide sequences of a gene of NRG1 and of a further gene, preferably a gene of CD74, are well known and can be deduced from databases like NCBI or EMBL. For example, the nucleotide sequence of the NRG1 gene can be deduced under accession number ID:3084 or NG_012005.1 or gi: 236459116:4553-1130291 from NCBI. Particularly, the nucleotide sequence of the NRG1 gene can be deduced under accession number gi: 236459116 from NCBI. The nucleotide sequence of the CD74 gene can be deduced under accession number ID:972 or NG_029730.1 or gi:343488507:5001-16300 from NCBI. Particularly, the nucleotide sequence of the CD74 gene can be deduced under accession number gi:343488507 from NCBI.

In accordance with the above, the fusion gene provided and to be used herein can comprise a gene of NRG1 having a nucleotide sequence as shown in NCBI Reference Sequence: NG_012005.1 (Gene ID: 3084; gi: 236459116) or a fragment thereof; and a gene of CD74 having a nucleotide sequence as shown in NCBI Reference Sequence: NG_029730.1 (Gene ID: 972; gi:343488507) or a fragment thereof.

The gene of NRG1 (or a fragment thereof) encodes an NRG1 protein (or a fragment thereof). Currently, several variant isoforms of NRG1 proteins are known. The exemplary respective amino acid sequences of said variant isoforms can be deduced under the following accession numbers from NCBI: NM_001159995.1, NM_001159996.1, NM_001159999.1, NM_001160001.1, NM_001160002.1, NM_001160004.1, NM_001160005.1, NM_001160007.1, NM_001160008.1, NM_004495.3, NM_013956.3, NM_013957.3, NM_013958.3, NM_013959.3, NM_013960.3, NM_013962.2 and, NM_013964.3. The amino acid sequences of said variant isoforms are encompassed herein and incorporated by reference. Accordingly, the term "gene of NRG1" refers to a gene encoding any one of the known (or yet to be identified) NRG1 isoform variants. Likewise, the term "a fragment of the gene of NRG1" refers to a fragment of said gene of NRG1 encoding a fragment of any one of the known (or yet to be identified) NRG1 isoform variants.

Likewise, the gene of a further fusion partner (like CD74) (or a fragment thereof) encodes a further protein (or a fragment thereof), like a CD74 protein (or a fragment thereof). Several variant isoforms of e.g. CD74 proteins are known. The respective amino acid sequences of said variant isoforms can be deduced under accession number the following accession numbers from NCBI: NM_001025158.2, NM_001025159.2 and, NM_004355.3. The amino acid sequences of said variant isoforms are encompassed herein and incorporated by reference. Accordingly, the term "gene of a further fusion partner" (like "gene of CD74") refers to a gene encoding any one of the known (or yet to be identified) isoform variants of further fusion partners, like CD74 isoform variants. Likewise, the term "a fragment of the gene of NRG1" refers to a fragment of said gene of further fusion partners (like CD74) encoding a fragment of any one of the known (or yet to be identified) isoform variants, like CD74 isoform variants.

In accordance with the above, the term "fusion gene comprising a nucleic acid encoding an NRG1 protein or a fragment of said protein and comprising a nucleic acid encoding a further protein" can relate to a "fusion gene comprising a gene encoding a NRG1 variant isoform or a fragment thereof and comprising a gene encoding a variant isoform of further fusion partners or a fragment thereof".

For the purpose of the present invention, the fusion gene provided and to be used herein comprises a nucleic acid encoding an NRG1 protein or a fragment of said protein and comprises a nucleic acid encoding a further protein or a fragment of said protein. Preferably, said further protein is a CD74 protein.

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a polypeptide having at least 70% identity to the polypeptide of any one of (a).

The fusion gene provided and to be used herein comprises a nucleic acid encoding a further protein or a fragment of said protein, preferably CD74 protein.

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 5;

(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 5; and
(b) a polypeptide having at least 70% identity to the polypeptide of any one of (a).

The fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the fusion gene comprises a nucleic acid encoding a CD74 protein or a fragment of said CD74 protein, wherein said CD74 protein is selected from the group consisting of
(a) a protein comprising the amino acid sequence as shown in SEQ ID NO: 5;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 5;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of any one of (a);
and
the fusion gene comprises a nucleic acid encoding a CD74 protein or a fragment of said CD74 protein, wherein said CD74 protein is selected from the group consisting of
(a) a protein comprising the amino acid sequence as shown in SEQ ID NO: 5; and
(b) a polypeptide having at least 70% identity to the polypeptide of any one of (a).

The fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 6;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the fusion gene provided and to be used herein comprises a nucleic acid encoding a CD74 protein or a fragment of said CD74 protein, wherein said CD74 protein is selected from the group consisting of (a) a protein comprising the amino acid sequence as shown in SEQ ID NO: 7;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 7;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

Preferably, the fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 6;
(b) a polypeptide having at least 70% identity to the polypeptide of any one of (a);

and
the fusion gene provided and to be used herein comprises a nucleic acid encoding a CD74 protein or a fragment of said CD74 protein, wherein said CD74 protein is selected from the group consisting of
(a) a protein comprising the amino acid sequence as shown in SEQ ID NO: 7; and
(b) a polypeptide having at least 70% identity to the polypeptide of any one of (a).

In a preferred embodiment, the fusion gene comprises a nucleic acid encoding an CD74-NRG1 protein or a fragment thereof,
wherein said CD74-NRG1 protein is selected from the group consisting of
(a) a protein comprising the amino acid sequence as shown in SEQ ID NO: 1;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 1;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

In a very preferred embodiment, the fusion gene comprises a nucleic acid encoding an CD74-NRG1 protein or a fragment thereof,
wherein said CD74-NRG1 protein is selected from the group consisting of
(a) a protein comprising the amino acid sequence as shown in SEQ ID NO: 1;
(b) a polypeptide having at least 70% identity to the polypeptide of any one of (a).

In accordance with the present invention, the fusion gene can comprise a nucleic acid encoding an NRG1 protein or a fragment of said protein and a nucleic acid encoding a further protein. For example, said further protein is an MTSS1 protein.

The present invention relates to a method for assessing whether a patient suffers from cancer or is prone to suffering from cancer, said method comprising
determining the presence of a fusion gene in a sample from said patient; and
assessing that said patient suffers from cancer or is prone to suffering from cancer when said fusion gene is present,
wherein said fusion gene comprises a nucleic acid encoding an NRG1 protein or a fragment of said protein and wherein said fusion gene comprises a nucleic acid encoding an MTSS1 protein or a fragment thereof.

In this context, the term "fusion gene" as used herein refers generally to a nucleic acid encoding an NRG1 protein or a fragment of said protein wherein the fusion gene further comprises a nucleic acid encoding an MTSS1 protein. The general definitions and explanations in relation to "fusion genes" apply here mutatis mutandis.

In accordance with the above and without deferring from the gist of the present invention, the "fusion gene" provided herein and to be used herein relates to a fusion of a gene of NRG1 (or of a fragment thereof) and a gene of MTSS1 (or of a fragment thereof). The nucleotide sequences of a gene of NRG1 and of MTSS1 are well known and can be deduced from databases like NCBI or EMBL. For example, the nucleotide sequence of the NRG1 gene can be deduced under accession number ID:3084 or NG_012005.1 or gi: 236459116:4553-1130291 from NCBI. Particularly, the nucleotide sequence of the NRG1 gene can be deduced under accession number gi: 236459116 from NCBI The nucleotide sequence of the MTSS1 gene can be deduced under accession number ID:9788 or NC_000008.10 or gi:224589820:c125740730-125563025 from NCBI. Particularly, the nucleotide sequence of the MTSS1 gene can be deduced under accession number gi:224589820 from NCBI.

In accordance with the above, the fusion gene provided and to be used herein can comprise a gene of NRG1 or a fragment thereof; and a gene of MTSS1 or a fragment thereof.

The fusion gene provided and to be used herein can comprise a gene of NRG1 having a nucleotide sequence as shown in NCBI Reference Sequence NG_012005.1 (Gene ID: 3084; gi: 236459116) or a fragment thereof; and a gene of MTSS1 having a nucleotide sequence as shown in NCBI Reference Sequence NC_000008.10 (Gene ID: 9788; gi:224589820) or a fragment thereof.

The fusion gene provided and to be used herein can comprise a gene of NRG1 having a nucleotide sequence as shown in NCBI Reference Sequence gi: 236459116 or a fragment thereof; and a gene of MTSS1 having a nucleotide sequence as shown in NCBI Reference Sequence gi:224589820 or a fragment thereof.

The terms "gene of NRG1"/"NRG1 gene" and "gene of MTSS1"/"MTSS1 gene" also relates to variants of the specific NRG1 genes and/or MTSS1 genes disclosed herein or deducible from the corresponding databases, like NCBI. Such variants are, for example, genetic variants, and encompass, for example, sequences hybridizing to the specific nucleic acid sequences or having, e.g. 70% identity to the nucleotide sequence of the "gene of NRG1"/"NRG1 gene" and "gene of MTSS1"/"MTSS1 gene", respectively, or of a fragment thereof.

For example, the term "gene of NRG1"/"NRG1 gene" refers to
(a) a nucleic acid encoding an NRG1 protein;
(b) a nucleic acid comprising a nucleotide sequence as depicted in NCBI Reference Sequence: NG_012005.1 (Gene ID: 3084; gi: 236459116);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

For example, the term "gene of MTSS1"/"MTSS1 gene" refers to
(a) a nucleic acid encoding an MTSS1 protein;
(b) a nucleic acid comprising a nucleotide sequence as depicted in NCBI Reference Sequence: Reference Sequence NC_000008.10 (Gene ID: 9788; gi:224589820);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene of NRG1 (or a fragment thereof) encodes an NRG1 protein (or a fragment thereof). Currently, several variant isoforms of NRG1 proteins are known. The exemplary respective amino acid sequences of said variant isoforms can be deduced the following accession numbers from NCBI: NM_001159995.1, NM_001159996.1, NM_001159999.1, NM_001160001.1, NM_001160002.1, NM_001160004.1, NM_001160005.1, NM_001160007.1, NM_001160008.1, NM_004495.3, NM_013956.3, NM_013957.3, NM_013958.3, NM_013959.3, NM_013960.3, NM_013962.2 and, NM_013964.3. The amino acid sequences of said variant isoforms are encompassed herein and incorporated by reference. Accordingly, the term "gene of NRG1" refers to a gene encoding any one of the known (or yet to be identified) NRG1 isoform variants. Likewise, the term "a fragment of the gene of NRG1" refers to a fragment of said gene of NRG1 encoding a fragment of any one of the known (or yet to be identified) NRG1 isoform variants.

Likewise, the gene of a further fusion partner (like MTSS1) (or a fragment thereof) encodes a further protein (or a fragment thereof), like an MTSS1 protein (or a fragment thereof). Several variant isoforms of e.g. MTSS1 proteins are known. The respective amino acid sequences of said variant isoforms can be deduced under accession number NM_014751.4 from NCBI. The amino acid sequences of said variant isoforms are encompassed herein and incorporated by reference. Accordingly, the term "gene of a further fusion partner" (like "gene of MTSS1") refers to a gene encoding any one of the known (or yet to be identified) isoform variants of further fusion partners, like MTSS1 isoform variants. Likewise, the term "a fragment of the gene of MTSS1" refers to a fragment of said gene of further fusion partners (like MTSS1) encoding a fragment of any one of the known (or yet to be identified) isoform variants, like MTSS1 isoform variants.

In accordance with the above, the term "fusion gene comprising a nucleic acid encoding an NRG1 protein or a fragment of said protein and comprising a nucleic acid encoding an MTSS1 protein" relates to a "fusion gene comprising a gene encoding a NRG1 variant isoform or a fragment thereof and comprising a gene encoding an MTSS1 variant isoform or a fragment thereof".

For the purpose of the present invention, the fusion gene provided and to be used herein comprises a nucleic acid encoding an NRG1 protein or a fragment of said protein and comprises a nucleic acid encoding a further protein, like an MTSS1 protein.

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of any one of (a).

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 13;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 13;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The MTSS1-NRG1 fusion gene provided and to be used herein comprises a nucleic acid encoding an NRG1 protein or a fragment of said protein, wherein said NRG1 protein is selected from the group consisting of (a) a protein comprising the amino acid sequence as shown in SEQ ID NO: 13;
(b) a polypeptide having at least 70% identity to the polypeptide of any one of (a).

The MTSS1-NRG1 fusion gene provided and to be used herein comprises a nucleic acid encoding an MTSS1 protein or a fragment of said MTSS1 protein, wherein said MTSS1 protein is selected from the group consisting of
(a) a protein comprising the amino acid sequence as shown in SEQ ID NO: 17;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 17;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The MTSS1-NRG1 fusion gene provided and to be used herein comprises a nucleic acid encoding a MTSS1 protein or a fragment of said MTSS1 protein, wherein said MTSS1 protein is selected from the group consisting of
(a) a protein comprising the amino acid sequence as shown in SEQ ID NO: 17; and
(b) a polypeptide having at least 70% identity to the polypeptide of any one of (a).

The MTSS1-NRG1 fusion gene provided and to be used herein comprises a nucleic acid encoding an MTSS1 protein or a fragment of said MTSS1 protein, wherein said MTSS1 protein is selected from the group consisting of
(a) a protein comprising the amino acid sequence as shown in SEQ ID NO: 14;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 14;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The MTSS1-NRG1 fusion gene provided and to be used herein comprises a nucleic acid encoding a MTSS1 protein or a fragment of said MTSS1 protein, wherein said MTSS1 protein is selected from the group consisting of
(a) a protein comprising the amino acid sequence as shown in SEQ ID NO: 14; and
(b) a polypeptide having at least 70% identity to the polypeptide of any one of (a).

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 4;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the MTSS1-NRG1 fusion gene comprises a nucleic acid encoding a MTSS1 protein or a fragment of said MTSS1 protein, wherein said MTSS1 protein is selected from the group consisting of
(a) a protein comprising the amino acid sequence as shown in SEQ ID NO: 17;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 17;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 4; and
(b) a polypeptide having at least 70% identity to the polypeptide of (a);
and
the MTSS1-NRG1 fusion gene comprises a nucleic acid encoding an MTSS1 protein or a fragment of said MTSS1 protein, wherein said MTSS1 protein is selected from the group consisting of
(a) a protein comprising the amino acid sequence as shown in SEQ ID NO: 17; and
(b) a polypeptide having at least 70% identity to the polypeptide of any one of (a).

The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 13;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 13;

(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d);
and
the MTSS1-NRG1 fusion gene provided and to be used herein comprises a nucleic acid encoding a MTSS1 protein or a fragment of said MTSS1 protein, wherein said MTSS1 protein is selected from the group consisting of
(a) a protein comprising the amino acid sequence as shown in SEQ ID NO: 14;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 14;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).
The MTSS1-NRG1 fusion gene provided and to be used herein comprises a nucleic acid encoding an NRG1 protein or a fragment of said protein, wherein said NRG1 protein is selected from the group consisting of
(a) a protein comprising the amino acid sequence as shown in SEQ ID NO: 13;
(b) a polypeptide having at least 70% identity to the polypeptide of any one of (a);
and
the MTSS1-NRG1 fusion gene provided and to be used herein comprises a nucleic acid encoding a MTSS1 protein or a fragment of said MTSS1 protein, wherein said MTSS1 protein is selected from the group consisting of
(a) a protein comprising the amino acid sequence as shown in SEQ ID NO: 14; and
(b) a polypeptide having at least 70% identity to the polypeptide of any one of (a).
The MTSS1-NRG1 fusion gene comprises a nucleic acid encoding an MTSS1-NRG1 protein or a fragment thereof, wherein said MTSS1-NRG1 protein is selected from the group consisting of
(a) a protein comprising the amino acid sequence as shown in SEQ ID NO: 10;
(b) a protein as defined in (a) wherein one or more amino acids are deleted, inserted, added or substituted;
(c) a polypeptide encoded by a nucleic acid molecule encoding a polypeptide comprising the amino acid sequence as shown in SEQ ID NO: 10;
(d) a polypeptide comprising an amino acid sequence encoded by a nucleic acid hybridizing under stringent conditions to the complementary strand of nucleic acid molecules as defined in (c);
(e) a polypeptide having at least 70% identity to the polypeptide of any one of (a) to (d); and
(e) a polypeptide comprising an amino acid sequence encoded by a nucleic acid being degenerate as a result of the genetic code to the nucleotide sequence of a nucleic acid as defined in (c) or (d).
The MTSS1-NRG1 fusion gene comprises a nucleic acid encoding an MTSS1-NRG1 protein or a fragment thereof, wherein said MTSS1-NRG1 protein is selected from the group consisting of
(a) a protein comprising the amino acid sequence as shown in SEQ ID NO: 10;
(b) a polypeptide having at least 70% identity to the polypeptide of any one of (a).

In the means and methods provided herein, it is envisaged that the term "fusion gene" relates to DNA, preferably genomic DNA. The term "fusion gene" can relate to cDNA. Particularly, in means and methods provided herein which relate to the determination of the presence of a fusion gene in a sample from a patient, the term "fusion gene" relates to DNA, preferably genomic DNA.

The following relates generally to the "sample" to be used in accordance with the present invention.

Generally, a sample of a patient suffering from cancer or being prone to suffer from cancer can be used. Accordingly, the methods of the present invention can comprise a step of obtaining a sample from the patient. Said sample may, for example, be obtained by (a) biopsy (biopsies). These mammalian tumor cell(s)/cancer cell(s) can, for example, be cells circulating in the blood of the patient. Therefore, the sample can also be a blood sample.

The sample comprises mammalian tumor cells or mammalian cancer cells, preferably human tumor cells or human cancer cells. These (human) tumor cells or (human) cancer cells can be (or be derived from) a solid tumor. Preferably, these (human) tumor cell(s) or (human) cancer cell(s) are (a) lung cancer cell(s) or (a) lung tumor cell(s). The lung cancer cell(s) or lung tumor cell(s) can be (a) lung adenocarcinoma cell(s), such as (an) mucinous adenocarcinoma cell(s), particularly invasive mucinous adenocarcinoma cell(s) The lung cancer cell(s) or lung tumor cell(s) can be (a) lung small cell lung cancer cell(s). The lung cancer cell(s) or lung tumor cell(s) can be (an) invasive mucinous adenocarcinoma cell(s).

The term "mammalian tumor cell(s)" used herein refers to (a) tumor cell(s) which is derived from or which is a tumor cell from a mammal, preferably a human. The "mammalian tumor cells" may be obtained from a sample, like a biopsy or blood sample, in particular (a) biopsy/biopsies/blood sample(s) from a patient/subject/individual suffering from cancer or, though less preferred, from a patient/subject/individual being prone to suffer from cancer.

The term "tumor cell(s)" also relates to "cancer cell(s)". In particular, the term "mammalian tumor cell(s)" or "mammalian tumor cell(s)" can refer to a tumor.

The sample is from a patient suffering from or being prone to suffer from cancer. The cancer may be a solid cancer, such as lung cancer. Preferably, the cancer is lung cancer. The lung cancer can be lung adenocarcinoma, such as mucinous adenocarcinoma, in particular invasive mucinous adenocarcinoma. The lung cancer can be mucinous lung adenocarcinoma. The lung cancer can be small cell lung cancer. The lung cancer can be invasive mucinous adenocarcinoma. The term invasive mucinous adenocarcinoma as used herein is known in the art; see, for example, Maeda (2012), Journal of Clinical Investigation, 122 (12, 4388-4400). Mucinous adenocarcinoma of the lung (formerly known as mucinous bronchioalveolar cancer) is pathologically classified as tumor cells with goblet cell morphology containing abundant intracytoplasmic mucin. Invasive mucinous adenocarcinoma of the lung has a higher malignant potential than do the more common types of lung adenocarcinoma, such as acinar or papillary adenocarcinoma. Mucinous adenocarcinoma of the lung is associated with decreased or absent expression of the transcription factor NK2 homeobox 1 (NKX2-1; also known as TTF-1) and the expression of mucins, including mucin 5AC, oligomeric mucus/gel-forming (MUC5AC).

In aspects of the present invention that relate to the CD74-NRG1 fusion gene as defined herein, it is preferred that the lung cancer is invasive mucinous adenocarcinoma. Correspondingly, it is preferred in this context that the sample comprises (a) invasive mucinous adenocarcinoma cell(s). In this context it is preferred that the patient is a human patient that never smoked. The term "never smoker" as used herein refers to an adult (i.e. an adult patient) who has never smoked (preferably who never smoked a cigarette) or who smoked fewer than about 100 cigarettes in their entire lifetime. Furthermore, it is preferred in this context that the tumor/cancer cells in the sample from the patient is(are) not characterized by "conventional" markers, like KRAS or EGFR mutations.

In aspects of the present invention that relate to an MTSS1-NRG1 fusion gene as defined herein, it is preferred that the lung cancer is small cell lung cancer. Correspondingly, it is preferred in this context that the sample comprises (a) small cell lung cancer cell(s).

Preferably, the patient is a human patient.

The following relates to determining the presence of a fusion gene. The following explanations and definitions apply to all aspects the present invention that relate to determining the presence of a fusion gene.

The presence of one or more fusion genes can, in accordance with the present invention, be performed using nucleic acid detection methods known by a person skilled in the art. These methods include hybridisation based methods. Accordingly, the presence of a fusion gene according to the present invention can be determined by a hybridisation assay. Preferably, the presence of said DNA is determined by in situ hybridization. Exemplary in situ hybridization assays are break-apart in situ hybridization (ba-FISH), fluorescent in situ hybridization (FISH), chromogenic in situ hybridization (CISH) and silver in situ hybridization (SISH). Herein preferred is the use of break-apart in situ hybridization (ba-FISH).

The in situ hybridization can comprise the steps
(a) contacting the nucleic acid in the sample with one or more of probe;
(b) incubating the sample under conditions allowing hybridization of the probe to the target sequence; and
(c) detecting hybridization.

The in situ hybridization can comprise a further step, like
(d) assessing that patient suffers from cancer, if DNA is determined to be present; or
(d) assessing the tumor cell or cancer cell as responsive to an inhibitor, if the presence of the DNA is determined.

The following probes can be used in accordance with the above, particularly in break-apart in situ hybridization (ba-FISH):
Centromeric probes (labelled in red): RP11-1002K11 and RP11-35D16
Telomeric probes (labelled in green): RP11-23A12 and RP11-715M18
The sequences of these probes are available from the UCSC Genome Browser.

The present invention relates to a method for assessing whether a patient suffers from cancer or is prone to suffering from cancer, said method comprising
    determining the presence of a gene product of a fusion gene in a sample from said patient; and
    assessing that said patient suffers from cancer or is prone to suffering from cancer when said gene product is present,
wherein said fusion gene comprises a nucleic acid encoding an NRG1 protein or a fragment of said protein and wherein said fusion gene comprises a nucleic acid encoding a further protein or a fragment thereof, preferably a CD74 protein or a fragment thereof.

The definitions and explanations given herein above in relation to the term "fusion gene" apply mutatis mutandis in this context.

The following relates to "gene products" and methods for determining the presence or amount thereof. Accordingly, the following explanations and definitions apply to all aspects the present invention that relate to determining the presence or amount of gene products of a fusion gene.

The following relates to "gene products" that are or comprise nucleic acids, particularly mRNA.

The gene product provided and to be used herein can comprise a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8; and
(c) a nucleic acid comprising a nucleotide sequence with at least 70% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO:6;
(b) a nucleic acid comprising a nucleotide sequence as depicted in SEQ ID NO:8; and
(c) a nucleic acid comprising a nucleotide sequence with at least 90% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO:6; and
(b) a nucleic acid comprising a nucleotide sequence as depicted in SEQ ID NO:8.

The gene product comprises a nucleic acid selected from the group consisting of
(a) a nucleic acid encoding a polypeptide comprising an amino acid sequence as depicted in SEQ ID NO: 7;

(b) a nucleic acid comprising a nucleotide sequence as depicted in SEQ ID NO: 9;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9; and
(c) a nucleic acid comprising a nucleotide sequence with at least 70% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO: 7;
(b) a nucleic acid comprising a nucleotide sequence as depicted in SEQ ID NO: 9; and
(c) a nucleic acid comprising a nucleotide sequence with at least 90% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO: 7; and
(b) a nucleic acid comprising a nucleotide sequence as depicted in SEQ ID NO: 9.

The gene product can be selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

Preferably, the gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1);
(c) a nucleic acid hybridizing under stringent conditions to the complementary strand of the nucleic acid as defined in (a) or (b);
(d) a nucleic acid comprising a nucleotide sequence with at least 90% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

In a preferred embodiment, the gene product is selected from the group consisting of
(a) a nucleic acid encoding a polypeptide comprising an amino acid sequence as depicted in SEQ ID NO: 1 (CD74-NRG1);
(b) a nucleic acid comprising a nucleotide sequence as depicted in SEQ ID NO: 3 (CD74-NRG1); and
(c) a nucleic acid comprising a nucleotide sequence with at least 90% identity to the nucleotide sequence of the nucleic acids of (a) or (b).

In a very preferred embodiment, the gene product is selected from the group consisting of
(a) a nucleic acid encoding a polypeptide comprising an amino acid sequence as depicted in SEQ ID NO: 1 (CD74-NRG1); and
(b) a nucleic acid comprising a nucleotide sequence as depicted in SEQ ID NO: 3 (CD74-NRG1).

Expression can be determined on nucleic acid level (e.g. if the gene product/product of the coding nucleic acid sequence is an unspliced/partially spliced/spliced mRNA) by taking advantage of Northern blotting techniques or PCR techniques, like in-situ PCR or Real time PCR. Quantitative determination of mRNA can be performed by taking advantage of northern blotting techniques, hybridization on microarrays or DNA chips equipped with one or more probes or probe sets specific for mRNA transcripts or PCR techniques referred to above, like, for example, quantitative PCR techniques, such as Real time PCR. These and other suitable methods for detection and/or determination of the concentration/amount of (specific) mRNA or protein(s)/polypeptide(s) are well known in the art and are, for example, described in Sambrook (2001), loc. cit.).

A skilled person is capable of determining the amount of mRNA or polypeptides/proteins, in particular the gene products described herein above, by taking advantage of a correlation, preferably a linear correlation, between the intensity of a detection signal and the amount of, for example, the mRNA or polypeptides/proteins to be determined.

Accordingly, amplification based methods can be used in accordance with the present invention. For example, the methods according to the present invention can determine the presence and/or amount of a fusion gene by an amplification assay.

Nucleic-acid amplification can be accomplished by any of the various nucleic-acid amplification methods known in the art, including but not limited to the polymerase chain reaction (PCR), ligase chain reaction (LCR), transcription-based amplification system (TAS), nucleic acid sequence based amplification (NASBA), rolling circle amplification (RCA), transcription-mediated amplification (TMA), self-sustaining sequence replication (3SR) and Qβ amplification.

Preferred methods use polymerase chain reaction (PCR) based methods.

The presence or amount of the nucleic acid (particularly of mRNA) can be determined by RealTime PCR, Reverse-Transcriptase PCR, Whole Transcriptome Shotgun Sequencing (RNAseq), in situ hybridization or micro-arrays.

The determination by RealTime PCR or ReverseTranscriptase PCR can further comprises the steps
(i) contacting the nucleic acid in the sample with one or two oligonucleotides; and
(ii) generating an amplification product containing the target sequence.

Oligonucleotides to be used in this context are primers allowing amplification around the fusion point (i.e. they amplify part of the first fusion partner (e.g. CD74 or MTSS1) and NRG1.

Exemplary oligonucleotides to be used for determining the presence or amount of a gene product of the CD74-NRG1 fusion gene as defined and provided herein are as follows:

```
Forward:      CTTCCCGGAGAACCTGAGAC
and/or

Reverse:      ATCTCGAGGGGTTTGAAAGG
```

Exemplary oligonucleotides to be used for determining the presence or amount of a gene product of the MTSS1-NRG1 fusion gene as defined and provided herein are as follows:

```
Forward-primer:  5'-CGCTCGGAGGCCTCTTCCAGA-3'
and/or

Reverse-primer:  5'-TGCGAAGTTCTGACTTCCCTGGC-3'
```

Other amplification methods may likewise be applied, these are for example, rolling circle amplification (such as in Liu, et al., "Rolling circle DNA synthesis: Small circular oligonucleotides as efficient templates for DNA polymerases," J. Am. Chem. Soc. 118:1587-1594 (1996).), isothermal amplification (such as in Walker, et al., "Strand displacement amplification—an isothermal, in vitro DNA amplification technique," Nucleic Acids Res. 20(7):1691-6 (1992)), ligase chain reaction (such as in Landegren, et al., "A Ligase-Mediated Gene Detection Technique," Science 241:1077-1080, 1988, or, in Wiedmann, et al., "Ligase Chain Reaction (LCR)—Overview and Applications," PCR Methods and Applications (Cold Spring Harbor Laboratory Press, Cold Spring Harbor Laboratory, N Y, 1994) pp. S51-S64.)). Polymerase chain reaction amplification is preferred.

The following relates to "gene products" that are or comprise polypeptide(s) or protein(s).

The gene product can comprise a polypeptide selected from the group consisting of
(a) a polypeptide comprising the amino acid sequence as depicted in SEQ ID NO:6;
(b) a polypeptide encoded by the nucleic acid of SEQ ID NO:8;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 6;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8; and
(c) a polypeptide having at least 70% identity to the polypeptide of (a) or (b).

The gene product comprises a polypeptide selected from the group consisting of
(a) a polypeptide comprising the amino acid sequence as depicted in SEQ ID NO:6;
(b) a polypeptide encoded by the nucleic acid of SEQ ID NO:8; and
(c) a polypeptide having at least 90% identity to the polypeptide of (a) or (b).

The gene product comprises a polypeptide selected from the group consisting of
(a) a polypeptide comprising the amino acid sequence as depicted in SEQ ID NO:6; and
(b) a polypeptide encoded by the nucleic acid of SEQ ID NO:8.

The gene product can comprise a polypeptide selected from the group consisting of
(a) a polypeptide comprising the amino acid sequence as depicted in SEQ ID NO: 7;
(b) a polypeptide encoded by the nucleic acid of SEQ ID NO: 9;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 7;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9; and
(c) a polypeptide having at least 70% identity to the polypeptide of (a) or (b).

The gene product comprises a polypeptide selected from the group consisting of
(a) a polypeptide comprising the amino acid sequence as depicted in SEQ ID NO: 7;
(b) a polypeptide encoded by the nucleic acid of SEQ ID NO: 9; and
(c) a polypeptide having at least 90% identity to the polypeptide of (a) or (b).

The gene product comprises a polypeptide selected from the group consisting of
(a) a polypeptide comprising the amino acid sequence as depicted in SEQ ID NO: 7; and
(b) a polypeptide encoded by the nucleic acid of SEQ ID NO: 9.

Preferably, the gene product is a polypeptide is selected from the group consisting of
(a) a polypeptide comprising the amino acid sequence of SEQ ID NO: 1 (CD74-NRG1);
(b) a polypeptide encoded by the nucleic acid of SEQ ID NO: 3 (CD74-NRG1);

(c) a polypeptide as defined in (a) or (b) wherein one or more amino acids are deleted, inserted, added or substituted;

(d) a polypeptide encoded by a nucleic acid molecule encoding a polypeptide comprising the amino acid sequence of SEQ ID NO: 1 (CD74-NRG1);

(e) a polypeptide comprising an amino acid sequence encoded by a nucleic acid hybridizing under stringent conditions to the complementary strand of nucleic acid molecules as defined in (b) or (d);

(f) a polypeptide having at least 70% identity to the polypeptide of any one of (a) to (e); and (g) a polypeptide comprising an amino acid sequence encoded by a nucleic acid being degenerate as a result of the genetic code to the nucleotide sequence of a nucleic acid as defined in any one of (b), (d) and (e).

More preferably, the gene product is a polypeptide is selected from the group consisting of (a) a polypeptide comprising the amino acid sequence of SEQ ID NO: 1 (CD74-NRG1);

(b) a polypeptide encoded by the nucleic acid of SEQ ID NO: 3 (CD74-NRG1); and (c) a polypeptide having at least 70% identity to the polypeptide of (a) or (b).

In a preferred embodiment, the gene product is a polypeptide is selected from the group consisting of (a) a polypeptide comprising the amino acid sequence of SEQ ID NO: 1 (CD74-NRG1);

(b) a polypeptide encoded by the nucleic acid of SEQ ID NO: 3 (CD74-NRG1); and (c) a polypeptide having at least 90% identity to the polypeptide of (a) or (b).

In a very preferred embodiment, the gene product is a polypeptide is selected from the group consisting of (a) a polypeptide comprising the amino acid sequence of SEQ ID NO: 1 (CD74-NRG1); and (b) a polypeptide encoded by the nucleic acid of SEQ ID NO: 3 (CD74-NRG1).

In the above aspects of the present invention, the gene product can be or is protein.

As mentioned, a person skilled in the art is aware of standard methods to be used for determining or quantitating expression of a fusion gene as defined herein. For example, the expression can be determined on the protein level by taking advantage of immunoagglutination, immunoprecipitation (e.g. immunodiffusion, immunelectrophoresis, immune fixation), western blotting techniques (e.g. (in situ) immuno histochemistry, (in situ) immuno cytochemistry, affinity chromatography, enzyme immunoassays), and the like. Amounts of purified polypeptide in solution can be determined by physical methods, e.g. photometry. Methods of quantifying a particular polypeptide in a mixture rely on specific binding, e.g. of antibodies. Specific detection and quantitation methods exploiting the specificity of antibodies comprise for example immunohistochemistry (in situ). For example, concentration/amount of proteins in a cell, tissue or a non-human animal can be determined by enzyme linked-immunosorbent assay (ELISA). Alternatively, Western Blot analysis or immunohistochemical staining can be performed. Western blotting combines separation of a mixture of proteins by electrophoresis and specific detection with antibodies. Electrophoresis may be multi-dimensional such as 2D electrophoresis. Usually, polypeptides are separated in 2D electrophoresis by their apparent molecular weight along one dimension and by their isoelectric point along the other direction.

For example, the presence or amount of the protein can be determined by immunohistochemistry (IHC), by immunoassay, gel- or blot-based methods, mass spectrometry, flow cytometry, or FACS.

The present invention relates to a method for assessing whether a patient suffers from cancer or is prone to suffering from cancer, said method comprising
    determining the presence of a gene product of a fusion gene in a sample from said patient; and
    assessing that said patient suffers from cancer or is prone to suffering from cancer when said gene product is present,
wherein said fusion gene comprises a nucleic acid encoding an NRG1 protein or a fragment of said protein and wherein said fusion gene comprises a nucleic acid encoding an MTSS1 protein or a fragment thereof.

The definitions and explanations given herein above in relation to the term "fusion gene" (particularly "MTSS1-NRG1" fusion gene) apply mutatis mutandis in this context.

The following aspects of the present invention relate to gene products of an MTSS1-NRG1 fusion gene as defined herein.

The following relates to "gene products" that are or comprise nucleic acids, particularly mRNA.

The gene product can comprise a nucleic acid selected from the group consisting of (a) a nucleic acid encoding a polypeptide comprising an amino acid sequence as depicted in SEQ ID NO:13;

(b) a nucleic acid comprising a nucleotide sequence as depicted in SEQ ID NO:15;

(c) a nucleic acid hybridizing under stringent conditions to the complementary strand of the nucleic acid as defined in (a) or (b);

(d) a nucleic acid comprising a nucleotide sequence with at least 70% identity to the nucleotide sequence of the nucleic acids of any one of (a) to (c); and (e) a nucleic acid comprising a nucleotide sequence which is degenerate as a result of the genetic code to the nucleotide sequence of a nucleic acid of any one of (a) to (d).

The gene product comprises a nucleic acid selected from the group consisting of (a) a nucleic acid encoding a polypeptide comprising an amino acid sequence as depicted in SEQ ID NO:13;

(b) a nucleic acid comprising a nucleotide sequence as depicted in SEQ ID NO:15; and (c) a nucleic acid comprising a nucleotide sequence with at least 70% identity to the nucleotide sequence of the nucleic acids of (a) or (b).

The gene product comprises a nucleic acid selected from the group consisting of (a) a nucleic acid encoding a polypeptide comprising an amino acid sequence as depicted in SEQ ID NO:13;

(b) a nucleic acid comprising a nucleotide sequence as depicted in SEQ ID NO:15; and (c) a nucleic acid comprising a nucleotide sequence with at least 90% identity to the nucleotide sequence of the nucleic acids of (a) or (b).

The gene product comprises a nucleic acid selected from the group consisting of (a) a nucleic acid encoding a polypeptide comprising an amino acid sequence as depicted in SEQ ID NO:13; and (b) a nucleic acid comprising a nucleotide sequence as depicted in SEQ ID NO:15.

The gene product comprises a nucleic acid selected from the group consisting of (a) a nucleic acid encoding a polypeptide comprising an amino acid sequence as depicted in SEQ ID NO: 14;

(b) a nucleic acid comprising a nucleotide sequence as depicted in SEQ ID NO: 16;
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The gene product comprises a nucleic acid selected from the group consisting of
(a) a nucleic acid encoding a polypeptide comprising an amino acid sequence as depicted in SEQ ID NO: 14;
(b) a nucleic acid comprising a nucleotide sequence as depicted in SEQ ID NO: 16; and
(c) a nucleic acid comprising a nucleotide sequence with at least 70% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO: 14;
(b) a nucleic acid comprising a nucleotide sequence as depicted in SEQ ID NO: 16; and
(c) a nucleic acid comprising a nucleotide sequence with at least 90% identity to the nucleotide sequence of the nucleic acids of (a) or (b).

The gene product comprises a nucleic acid selected from the group consisting of
(a) a nucleic acid encoding a polypeptide comprising an amino acid sequence as depicted in SEQ ID NO: 14; and
(b) a nucleic acid comprising a nucleotide sequence as depicted in SEQ ID NO: 16.

The gene product can be selected from the group consisting of
(a) a nucleic acid encoding a polypeptide comprising an amino acid sequence as depicted in SEQ ID NO: 10 (MTSS1-NRG1);
(b) a nucleic acid comprising a nucleotide sequence as depicted in SEQ ID NO: 12 (MTSS1-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

Preferably, the gene product is selected from the group consisting of
(a) a nucleic acid encoding a polypeptide comprising an amino acid sequence as depicted in SEQ ID NO: 10 (MTSS1-NRG1);
(b) a nucleic acid comprising a nucleotide sequence as depicted in SEQ ID NO: 12 (MTSS1-NRG1);
(c) a nucleic acid hybridizing under stringent conditions to the complementary strand of the nucleic acid as defined in (a) or (b);
(d) a nucleic acid comprising a nucleotide sequence with at least 90% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

In a preferred embodiment, the gene product is selected from the group consisting of
(a) a nucleic acid encoding a polypeptide comprising an amino acid sequence as depicted in SEQ ID NO: 10 (MTSS1-NRG1);
(b) a nucleic acid comprising a nucleotide sequence as depicted in SEQ ID NO: 12 (MTSS1-NRG1); and
(c) a nucleic acid comprising a nucleotide sequence with at least 90% identity to the nucleotide sequence of the nucleic acids of (a) or (b).

In a very preferred embodiment, the gene product is selected from the group consisting of
(a) a nucleic acid encoding a polypeptide comprising an amino acid sequence as depicted in SEQ ID NO: 10 (MTSS1-NRG1); and
(b) a nucleic acid comprising a nucleotide sequence as depicted in SEQ ID NO: 12 (MTSS1-NRG1).

The following relates to "gene products" of a MTSS1-NRG1 fusion gene that are or comprise polypeptide(s) or protein(s).

The gene product can comprise a polypeptide selected from the group consisting of
(a) a polypeptide comprising the amino acid sequence as depicted in SEQ ID NO:13;
(b) a polypeptide encoded by the nucleic acid of SEQ ID NO:15;
(c) a polypeptide as defined in (a) or (b) wherein one or more amino acids are deleted, inserted, added or substituted
(d) a polypeptide encoded by a nucleic acid molecule encoding a polypeptide comprising the amino acid sequence of SEQ ID NO: 13;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The gene product comprises a polypeptide selected from the group consisting of
(a) a polypeptide comprising the amino acid sequence as depicted in SEQ ID NO:13;
(b) a polypeptide encoded by the nucleic acid of SEQ ID NO:15; and
(c) a polypeptide having at least 70% identity to the polypeptide of (a) or (b).

The gene product comprises a polypeptide selected from the group consisting of
(a) a polypeptide comprising the amino acid sequence as depicted in SEQ ID NO:13;
(b) a polypeptide encoded by the nucleic acid of SEQ ID NO:15; and
(c) a polypeptide having at least 90% identity to the polypeptide of (a) or (b).

The gene product comprises a polypeptide selected from the group consisting of
(a) a polypeptide comprising the amino acid sequence as depicted in SEQ ID NO:13; and
(b) a polypeptide encoded by the nucleic acid of SEQ ID NO:15.

The gene product can comprise a polypeptide selected from the group consisting of
(a) a polypeptide comprising the amino acid sequence as depicted in SEQ ID NO: 14;

(b) a polypeptide encoded by the nucleic acid of SEQ ID NO: 16;
(c) a polypeptide as defined in (a) or (b) wherein one or more amino acids are deleted, inserted, added or substituted
(d) one or more of a polypeptide encoded by a nucleic acid molecule encoding a polypeptide comprising the amino acid sequence of SEQ ID NO: 14;
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The gene product comprises a polypeptide selected from the group consisting of
(a) a polypeptide comprising the amino acid sequence as depicted in SEQ ID NO: 14;
(b) a polypeptide encoded by the nucleic acid of SEQ ID NO: 16; and
(c) a polypeptide having at least 70% identity to the polypeptide of (a) or (b).

The gene product comprises a polypeptide selected from the group consisting of
(a) a polypeptide comprising the amino acid sequence as depicted in SEQ ID NO: 14;
(b) a polypeptide encoded by the nucleic acid of SEQ ID NO: 16; and
(c) a polypeptide having at least 90% identity to the polypeptide of (a) or (b).

The gene product comprises a polypeptide selected from the group consisting of
(a) a polypeptide comprising the amino acid sequence as depicted in SEQ ID NO: 14; and
(b) a polypeptide encoded by the nucleic acid of SEQ ID NO: 16.

Preferably, the gene product is a polypeptide is selected from the group consisting of
(a) a polypeptide comprising the amino acid sequence of SEQ ID NO: 10 (MTSS1-NRG1);
(b) a polypeptide encoded by the nucleic acid of SEQ ID NO: 12 (MTSS1-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO: 10 (MTSS1-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

More preferably, the gene product is a polypeptide is selected from the group consisting of
(a) a polypeptide comprising the amino acid sequence of SEQ ID NO: 10 (MTSS1-NRG1);
(b) a polypeptide encoded by the nucleic acid of SEQ ID NO: 12 (MTSS1-NRG1); and
(c) a polypeptide having at least 70% identity to the polypeptide of (a) or (b).

In a preferred embodiment, the gene product is a polypeptide is selected from the group consisting of
(a) a polypeptide comprising the amino acid sequence of SEQ ID NO: 10 (MTSS1-NRG1);
(b) a polypeptide encoded by the nucleic acid of SEQ ID NO: 12 (MTSS1-NRG1); and
(c) a polypeptide having at least 90% identity to the polypeptide of (a) or (b).

In a very preferred embodiment, the gene product is a polypeptide is selected from the group consisting of
(a) a polypeptide comprising the amino acid sequence of SEQ ID NO: 10 (MTSS1-NRG1); and
(b) a polypeptide encoded by the nucleic acid of SEQ ID NO: 12 (MTSS1-NRG1).

The present invention relates to method for assessing whether a patient suffers from cancer or is prone to suffering from cancer, said method comprising
determining the amount of a gene product of a fusion gene in a sample from said patient; and
assessing that said patient suffers from cancer or is prone to suffering from cancer when the amount of said gene product is increased in comparison to a control,
wherein said fusion gene comprises a nucleic acid encoding an NRG1 protein or a fragment of said protein and wherein said fusion gene comprises a nucleic acid encoding a further protein or a fragment thereof, preferably a CD74 protein of a fragment thereof.

Methods allowing the determination of the amount of a gene product on mRNA level and protein level have been described above.

If the gene product is mRNA, the amount of mRNA is at least 2.5-fold, preferably at least 5-fold increased in comparison to the control. For example, said amount may be at least 1.5, 2.5-fold, or at least 5-fold increased in comparison to the control. The (protein) expression level, may, for example, be at least 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold 2.8-fold, 2.9-fold, 3.0-fold, 3.1-fold, 3.2-fold, 3.3-fold, 3.4-fold, 3.5-fold, 4.0-fold, 5-fold, 5.5-fold, 6-fold, 7-fold, 8-fold, 9-fold, 10-fold, 11-fold, 12-fold, 13-fold, 14-fold, 15-fold or more increased in comparison to the control.

If the gene product is protein, the amount of protein is at least 2.5-fold, preferably at least 5-fold increased in comparison to the control. For example, said amount of protein may be at least 1.5, 2.5-fold, or at least 5-fold increased in comparison to the control. The (protein) expression level may, for example, be at least 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold 2.8-fold, 2.9-fold, 3.0-fold, 3.1-fold, 3.2-fold, 3.3-fold, 3.4-fold, 3.5-fold, 4.0-fold, 5-fold, 5.5-fold, 6-fold, 7-fold, 8-fold, 9-fold, 10-fold, 11-fold, 12-fold, 13-fold, 14-fold, 15-fold or more increased in comparison to the control.

A further non-limiting example of a "control" may be a "healthy" control, for example a sample/cell/tissue obtained from a healthy individual or patient that is not suffering from a cancer/tumor or a cell obtained from such a subject. In accordance with the above, the reference or control status e.g. of a gene product of a fusion gene as defined herein is that determined in (a sample of) the corresponding healthy control individual/patient, i.e. it is the "normal" status of e.g. a gene product of a fusion gene as defined herein. The control may also be a sample/cell/tissue obtained from the individual or patient suspected of suffering from the cancer provided that the sample/cell/tissue does not contain tumor or cancer cells. In a further alternative, the "control" may be a sample/cell/tissue obtained from an individual or patient suffering from the cancer, that has been obtained prior to the development or diagnosis of said cancer.

The definitions and explanations given herein above in relation to the terms "fusion gene" and "gene product" apply mutatis mutandis in this context.

The present invention relates to a method for assessing whether a patient suffers from cancer or is prone to suffering from cancer, said method comprising
   determining the amount of a gene product of a fusion gene in a sample from said patient; and
   assessing that said patient suffers from cancer or is prone to suffering from cancer when the amount of said gene product is increased in comparison to a control,
wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The present invention relates to a method for assessing whether a tumor cell or a cancer cell is responsive to an inhibitor, said method comprising
   determining the presence of a fusion gene in a sample of a patient,
   assessing that said tumor cell or cancer cell is responsive to said inhibitor, when said fusion gene is present,
wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment thereof.

The present invention relates to a method for assessing whether a lung tumor cell or a lung cancer cell is responsive to an inhibitor of a member of the ERBB family or an inhibitor of a ligand of a member of the ERBB family, or an inhibitor of a component of a pathway activated by the ERBB receptor family, or an inhibitor of NRG1, said method comprising
   determining the presence of a fusion gene or of a gene product of a fusion gene in a sample of a patient,
   assessing that said lung tumor cell or lung cancer cell is responsive to said inhibitor, when said fusion gene is present or when said gene product of a fusion gene is present,
wherein said fusion gene comprises a nucleic acid encoding an NRG1 protein or a fragment of said protein and wherein said fusion gene comprises a nucleic acid encoding a further protein or a fragment of said protein.

The definitions and explanations given herein above in relation to the term "fusion gene" apply mutatis mutandis in this context.

As used herein the term "responsiveness to the inhibitor" or "responsive patient to the inhibitor" means in the context of the present invention that a mammalian tumor cell (or mammalian tumor) or mammalian cancer cell (or mammalian cancer) or a patient suffering from cancer or being prone to suffer from cancer shows a response to an inhibitor (or treatment with an inhibitor).

The responsiveness of a tumor cell or a cancer cell from a sample is preferably assessed before a patient is to be subject to (co-)therapy with one or more of the herein provided inhibitors. Thus, the success of a therapy with one or more of the inhibitors can be assessed prior to the start of the therapy. If a patient is predicted not to respond, another therapy or course of action can be contemplated.

In case a patient is diagnosed positive in the method for assessing whether a patient suffers from cancer or is prone to suffering from cancer according to the invention or is predicted to respond, the patient may be treated using conventional chemotherapeutic treatment and/or treated with a HER2 and/or HER3 inhibitor.

In case a patient is diagnosed negative in the method for assessing whether a patient suffers from cancer or is prone to suffering from cancer according to the invention or is predicted to not respond, the status of the patient may be assessed using other markers such as EGFR mutations and translocations affecting ALK, ROS1, and RET genes. Accordingly, they may be treated using conventional chemotherapeutic treatment.

Conventional chemotherapy includes, particularly in the case of lung cancer, more in particular in the case of lung adenocarcinoma, anthracycline/taxane chemotherapy, therapy with an anti-metabolite agents, therapy with an anti-hormonal compound, therapy with an anti-estrogen, therapy with a tyrosine kinase inhibitor, therapy with a raf inhibitor, therapy with a ras inhibitor, therapy with a dual tyrosine kinase inhibitor, therapy with taxol, therapy with taxane, therapy with doxorubicin, therapy with adjuvant (anti-) hormone drugs, and/or therapy with cisplatin and the like.

Whether a patient predicted to respond in accordance with the present invention, does indeed respond to therapy with an inhibitor as defined herein can be determined by routine techniques. An artisan will readily be in the position to confirm that (a) cell(s) or individual(s) predicted to be responsive to an inhibitor (i.e. assessed as responsive in accordance with the present invention) shows indeed a response to the inhibitor (or to treatment with an inhibitor). For example, a response to an inhibitor may be reflected in a decreased suffering from cancer, such as a diminished and/or halted growth of a tumor and/or a reduction of the size of a tumor, the prevention of the formation of metastases or a reduction of number or size of metastases.

For example, the number of cancer/tumor cells in a sample from a patient prior to start of treatment with an inhibitor, optionally in a sample from a patient during the treatment with an inhibitor and in a sample from a patient after termination of the treatment with an inhibitor can be determined to confirm that the patient did indeed respond to the inhibitor. A decrease of tumor/cancer cells in a sample from a patient during or after termination of the treatment with an inhibitor compared to the initial number of proliferative diseased cells (i.e. the number of cells in a sample from a patient prior to start of treatment with an inhibitor) can be used to confirm that the patient did indeed respond to the inhibitor.

The term "responder" as used herein can refer to patients with complete remission (CR), complete remission with incomplete haematological recovery (CRi), complete remission with incomplete platelate recovery (CRp), and partial remission (PR). Patients with stable disease (SD) or no response can be seen as "non-responder".

The term "inhibitor" as used herein refers to (an) inhibitor of a member of the ERBB family or (an) inhibitor of a ligand of a member of the ERBB family. The term "member of the ERBB family" as used herein refers to ERBB1, ERBB2, ERBB3 and ERBB4. These terms are known in the art.

Accordingly, the term "inhibitor" as used herein refers to an inhibitor of ERBB1, ERBB2, ERBB3 and ERBB4 or to an inhibitor of a ligand of ERBB1, ERBB2, ERBB3 and ERBB4 or to an inhibitor of one of the signaling components downstream of these receptors. Herein preferred are inhibitors of ERBB2, inhibitors of ERBB3, inhibitors of their ligands (preferably EGF, or NRG1) or inhibitors of the signaling components downstream of these receptors. Exemplary inhibitors of EGF are therapeutic antibodies to EGF.

The following exemplary and known inhibitors can be used in accordance with the present invention:

Inhibitors of ERBB1 likecetuximab, panitumumab, gefitinib, erlotinib, lapatinib, neratinib, afatinib, MEHD7945A, dacomitinib, CO-1686, CNX-2006, canertinib, canertinib, TAK-285, AST-1306, icotinib, AEE788, pelitinib, CUDC-101, WZ4002, BMS-599626, mubritinib, zalutumumab, nimotuzumab, or matuzumab;

Inhibitors of ERBB2 like trastuzumab, pertuzumab, T-DM1, lapatinib, neratinib, afatinib, 17-AAG, IPI-504, ALM, CP-724714, ARRY-380, AZD8931, or mubritinib;

Inhibitors of ERBB3 like ALM, MM-121, AMG-888, MEHD7945A, canertinib, or AZD8931;

Inhibitors of ERBB4 like varlitinib or canertinib;

Inhibitors of ligands like CRM197 or RB200;

Inhibitors of signaling components downstream of these receptors like GSK2118436, PLX4032, GSK1120212, AZD6244, GDC-0941, PX-886, MK2206, GDC-0068, rapamycin, or INK128

Neuregulins (NRGs) provide the ligands for ERBB receptors, leading to their activation and the consequent activation of their downstream pathways. Therefore, blocking any of the three levels, ligand, receptor or downstream effector, can be targeted to stop the proliferative signal. Accordingly, the use of an inhibitor of a member of the ERBB family (like an inhibitor of ERBB1, ERBB2, ERBB3 or ERBB4) or an inhibitor of a ligand of a member of the ERBB family (like an inhibitor of a ligand of ERBB1, ERBB2, ERBB3 or ERBB4) or an inhibitor of a component of a pathway activated by the ERBB receptor family, or an inhibitor of NRG1, is envisaged herein. NRG1 is a ligand of a member of the ERBB family. The use of an inhibitor of NRG1 for the methods and uses of the present invention is encompassed herein. Also included is the use of inhibitors of fusion proteins comprising NRG1 (or fragments or variants thereof) as provided and defined herein. It is understood that the inhibitor of a member of the ERBB family (like an inhibitor of ERBB1, ERBB2, ERBB3 or ERBB4), the inhibitor of a ligand of a member of the ERBB family (like an inhibitor of a ligand of ERBB1, ERBB2, ERBB3 or ERBB4), the inhibitor of a component of a pathway activated by the ERBB receptor family, or the inhibitor of NRG1 target the member of the ERBB family (like ERBB1, ERBB2, ERBB3 or ERBB4), the ligand of a member of the ERBB family (like a ligand of ERBB1, ERBB2, ERBB3 or ERBB4), the component of a pathway activated by the ERBB receptor family, or NRG1, respectively.

The above exemplary inhibitors to be used in accordance with the present invention can be non-selective, i.e. pan inhibitors. Also envisaged herein is the use of selective inhibitors.

Selectivity expresses the biologic fact that at a given compound concentration enzymes (or proteins) are affected to different degrees. In the case of enzymes selective inhibition can be defined as preferred inhibition by a compound at a given concentration. Or in other words, an enzyme is selectively inhibited over another enzyme when there is a concentration which results in inhibition of the first enzyme whereas the second enzyme is not affected (or second enzyme is covalent bound to the first enzyme). To compare compound effects on different enzymes it is crucial to employ similar assay formats.

The inhibitors to be used herein are, for example, specific for ERBB3, i.e. the compounds specifically inhibit ERBB3 and are therefore, selective ERBB3 inhibitors. This explanation applies mutatis mutandis to selective inhibitors of ERBB2, inhibitors of ERBB3, inhibitors of their ligands (preferably EGF) or inhibitors of the signaling components downstream of these receptors inhibitors (or the other inhibitors mentioned above).

As described in more detail below, use of inhibitors in accordance with the present invention is not limited to the herein described inhibitors. Also further inhibitors may be used, for example, small (binding) molecules, aptamers, intramers, antisense molecules, extracellular binding-partners, or antibody molecules such as a full antibody (immunoglobulin), a F(ab)-fragment, a F(ab)$_2$-fragment, a single-chain antibody, a chimeric antibody, a CDR-grafted antibody, a bivalent antibody-construct, a synthetic antibody, a bispecific single chain antibody or a cross-cloned antibody.

Accordingly, also yet unknown inhibitors may be used in accordance with the present invention. Such inhibitors may be identified by the methods described and provided herein and methods known in the art, like high-throughput screening using biochemical assays for inhibition of the herein above described members of the ERBB family, ligands thereof and downstream pathways. Assays for screening of potential inhibitors and, in particular, for identifying inhibitors as defined herein, comprise, for example, in vitro competition binding assays to quantitatively measure interactions between test compounds and recombinantly expressed members of the ERBB family.

Competition with immobilized capture compounds and free test compounds is performed. Test compounds that bind the active sites will reduce the amount of ligands captured on solid support, whereas test molecules that do not bind the member of the ERBB family have no effect on the amount of ligands thereof captured on the solid support. Furthermore, inhibitor selectivity can also be assessed in parallel enzymatic assays for a set of recombinant members of the ERBB family. These assays are based on the measurement of the inhibitory effect of an inhibitor and determination of the concentration of compound required for 50% inhibition of the member of the ERBB family. Proteomics methods are also an efficient tool to identify cellular targets of inhibitors.

Based on his general knowledge a person skilled in the art is in the position to identify inhibitors or verify the inhibiting activity of compounds suspected of being inhibitors. These tests may be employed on cell(s) or cell culture(s) described in the appended example, but also further cell(s)/tissue(s)/cell culture(s) may be used, such as cell(s)/tissue(s)/cell culture(s) derived from biopsies.

The present invention relates to a method for assessing whether a tumor cell or a cancer cell is responsive to an inhibitor, said method comprising
  determining the presence of a fusion gene in a sample of a patient,
  assessing that said tumor cell or cancer cell is responsive to said inhibitor, when said fusion gene is present,
wherein said fusion gene comprises a nucleic acid encoding an NRG1 protein or a fragment of said protein and wherein said fusion gene comprises a nucleic acid encoding an MTSS1 protein or a fragment thereof.

The definitions and explanations given herein above in relation to the term "fusion gene" (particularly "MTSS1-NRG1" fusion gene) apply mutatis mutandis in this context.

The present invention relates to a method for assessing whether a tumor cell or a cancer cell is responsive to an inhibitor, said method comprising
  determining the presence of a gene product of a fusion gene in a sample of a patient,
  assessing that said tumor cell or cancer cell is responsive to said inhibitor, when said gene product is present,
wherein said fusion gene comprises a nucleic acid encoding an NRG1 protein or a fragment of said protein and wherein said fusion gene comprises a nucleic acid encoding a further protein or a fragment of said protein, preferably an CD74 protein or a fragment of said protein.

The definitions and explanations given herein above in relation to the term "fusion gene" and "gene product" apply mutatis mutandis in this context.

The present invention relates to a method for assessing whether a tumor cell or a cancer cell is responsive to an inhibitor, said method comprising
  determining the presence of a gene product of a fusion gene in a sample of a patient,
  assessing that said tumor cell or cancer cell is responsive to said inhibitor, when said gene product is present,
wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The present invention relates to a method for assessing whether a tumor cell or a cancer cell is responsive to an inhibitor, said method comprising
  determining the amount of a gene product of a fusion gene in a sample of a patient,
  assessing that said tumor cell or cancer cell is responsive to said inhibitor, when the amount of said gene product is increased in comparison to a control,
wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" and "gene product" apply mutatis mutandis in this context.

As used in context of the methods of the present invention, a non-limiting example of a "control" is preferably a "non-responder" control, for example a sample/cell/tissue obtained from one or more healthy individuals or one or more patients that suffer from a cancer/tumor and are known to be not responsive to an inhibitor. Another example for a "non-responder" control is a cell line/sample/cell/tissue that shows no response to an inhibitor in an ex-vivo test. Another non-limiting example of a "control" is an "internal standard", for example a mixture of purified or synthetically produced gene products (like mRNA or proteins and/or peptides), where the amounts of each protein/peptide is gauged by using the "non-responder" control described above. In particular, this mixture can contain the gene products of the fusion genes as described and defined herein.

A further non-limiting example of a "control" may be a "healthy" control, for example a sample/cell/tissue obtained from a healthy individual or patient that is not suffering from a cancer/tumor or a cell obtained from such a subject. In accordance with the above, the reference or control status e.g. of the fusion gene is that determined in (a sample of) the corresponding healthy control individual/patient, i.e. it is the "normal" status of the fusion gene (In healthy "control" samples, the fusion gene is usually absent/not detectable). The control may also be a sample/cell/tissue obtained from the individual or patient suspected of suffering from the cancer provided that the sample/cell/tissue does not contain tumor or cancer cells. In a further alternative, the "control" may be a sample/cell/tissue obtained from an individual or patient suffering from the cancer, that has been obtained prior to the development or diagnosis of said cancer.

The present invention relates to a method for assessing whether a tumor cell or a cancer cell is responsive to an inhibitor, said method comprising
  determining the amount of a gene product of a fusion gene in a sample of a patient,
  assessing that said tumor cell or cancer cell is responsive to said inhibitor, when the amount of said gene product is increased in comparison to a control,
wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The herein above provided methods can further comprise administering an inhibitor as defined herein above to the patient.

The present invention relates to a nucleic acid selected from the group consisting of
(a) a nucleic acid encoding a polypeptide comprising an amino acid sequence as depicted in SEQ ID NO:1 (CD74-NRG1);
(b) a nucleic acid comprising a nucleotide sequence as depicted in SEQ ID NO: 2 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid, wherein said nucleic acid is selected from the group consisting of
(a) a nucleic acid encoding a polypeptide comprising an amino acid sequence as depicted in SEQ ID NO:1 (CD74-NRG1);
(b) a nucleic acid comprising a nucleotide sequence as depicted in SEQ ID NO: 2 (CD74-NRG1); and
(c) a nucleic acid comprising a nucleotide sequence with at least 90% identity to the nucleotide sequence of the nucleic acids of (a) or (b).

The nucleic acid is selected from the group consisting of
(a) a nucleic acid encoding a polypeptide consisting of an amino acid sequence as depicted in SEQ ID NO:1 (CD74-NRG1);
(b) a nucleic acid consisting of a nucleotide sequence as depicted in SEQ ID NO: 2 (CD74-NRG1); and (c) a nucleic acid comprising a nucleotide sequence with at least 90% identity to the nucleotide sequence of the nucleic acids of (a) or (b).

The nucleic acid consists of a nucleotide sequence as depicted in SEQ ID NO: 2 (CD74-NRG1). The nucleic acid can be cDNA.

The present invention relates to a polypeptide selected from the group consisting of
(a) a polypeptide comprising the amino acid sequence of SEQ ID NO:1 (CD74-NRG1);
(b) a polypeptide encoded by the nucleic acid of SEQ ID NO: 2 (CD74-NRG1) or SEQ ID NO. 3 (CD74-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO:1 (CD74-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The polypeptide is selected from the group consisting of
(a) a polypeptide comprising the amino acid sequence of SEQ ID NO:1 (CD74-NRG1);
(b) a polypeptide encoded by the nucleic acid of SEQ ID NO: 2 (CD74-NRG1) or SEQ ID NO: 3 (CD74-NRG1); and
(c) a polypeptide having at least 90% identity to the polypeptide of (a) or (b).

The polypeptide is selected from the group consisting of
(a) a polypeptide consisting of the amino acid sequence of SEQ ID NO: 1 (CD74-NRG1);
(b) a polypeptide encoded by the nucleic acid of SEQ ID NO: 2 (CD74-NRG1) or SEQ ID NO: 3 (CD74-NRG1); and
(c) a polypeptide having at least 90% identity to the polypeptide of (a) or (b).

The polypeptide consists of the amino acid sequence of SEQ ID NO: 1 (CD74-NRG1).

The present invention relates to a nucleic acid selected from the group consisting of
(a) a nucleic acid encoding a polypeptide comprising an amino acid sequence as depicted in SEQ ID NO:1 (CD74-NRG1);
(b) a nucleic acid comprising a nucleotide sequence as depicted in SEQ ID NO: 2 (CD74-NRG1);
(c) a nucleic acid hybridizing under stringent conditions to the complementary strand of the nucleic acid as defined in (a) or (b);
(d) a nucleic acid comprising a nucleotide sequence with at least 70% identity to the nucleotide sequence of the nucleic acids of any one of (a) to (c); and
(e) a nucleic acid comprising a nucleotide sequence which is degenerate as a result of the genetic code to the nucleotide sequence of a nucleic acid of any one of (a) to (d).

The present invention relates to a nucleic acid, wherein said nucleic acid is selected from the group consisting of
(a) a nucleic acid encoding a polypeptide comprising an amino acid sequence as depicted in SEQ ID NO:10 (MTSS1-NRG1);
(b) a nucleic acid comprising a nucleotide sequence as depicted in SEQ ID NO: 11 (MTSS1-NRG1); and
(c) a nucleic acid comprising a nucleotide sequence with at least 90% identity to the nucleotide sequence of the nucleic acids of (a) or (b).

The nucleic acid is selected from the group consisting of
(a) a nucleic acid encoding a polypeptide consisting of an amino acid sequence as depicted in SEQ ID NO:10 (MTSS1-NRG1);
(b) a nucleic acid consisting of a nucleotide sequence as depicted in SEQ ID NO: 11 (MTSS1-NRG1); and
(c) a nucleic acid comprising a nucleotide sequence with at least 90% identity to the nucleotide sequence of the nucleic acids of (a) or (b).

The nucleic acid consists of a nucleotide sequence as depicted in SEQ ID NO: 12 (MTSS1-NRG1). The nucleic acid can be cDNA.

The present invention relates to a polypeptide selected from the group consisting of
(a) a polypeptide comprising the amino acid sequence of SEQ ID NO:10 (MTSS1-NRG1);
(b) a polypeptide encoded by the nucleic acid of SEQ ID NO: 11 (MTSS1-NRG1) or SEQ ID NO. 12 (MTSS1-NRG1);
(c) a polypeptide as defined in (a) or (b) wherein one or more amino acids are deleted, inserted, added or substituted;
(d) a polypeptide encoded by a nucleic acid molecule encoding a polypeptide comprising the amino acid sequence of SEQ ID NO:10 (MTSS1-NRG1);
(e) a polypeptide comprising an amino acid sequence encoded by a nucleic acid hybridizing under stringent conditions to the complementary strand of nucleic acid molecules as defined in (b) or (d);
(f) a polypeptide having at least 70% identity to the polypeptide of any one of (a) to (e); and
(g) a polypeptide comprising an amino acid sequence encoded by a nucleic acid being degenerate as a result of the genetic code to the nucleotide sequence of a nucleic acid as defined in any one of (b), (d) and (e).

The polypeptide is selected from the group consisting of
(a) a polypeptide comprising the amino acid sequence of SEQ ID NO:10 (MTSS1-NRG1);
(b) a polypeptide encoded by the nucleic acid of SEQ ID NO: 11 (MTSS1-NRG1) or SEQ ID NO: 12 (MTSS1-NRG1); and
(c) a polypeptide having at least 90% identity to the polypeptide of (a) or (b).

The polypeptide is selected from the group consisting of
(a) a polypeptide consisting of the amino acid sequence of SEQ ID NO: 10 (MTSS1-NRG1);
(b) a polypeptide encoded by the nucleic acid of SEQ ID NO: 11 (CD74-NRG1) or SEQ ID NO: 12 (MTSS1-NRG1); and
(c) a polypeptide having at least 90% identity to the polypeptide of (a) or (b).

The polypeptide consists of the amino acid sequence of SEQ ID NO: 10 (MTSS1-NRG1).

The meaning of the term "polypeptide" and "nucleic acid sequence(s)/molecule(s)" are well known in the art and are used accordingly in context of the present invention. For example, "nucleic acid sequence(s)/molecule(s)" as used herein refer(s) to all forms of naturally occurring or recombinantly generated types of nucleic acids and/or nucleic acid sequences/molecules as well as to chemically synthesized nucleic acid sequences/molecules. This term also encompasses nucleic acid analogues and nucleic acid derivatives such as e. g. locked DNA, PNA, oligonucleotide thiophosphates and substituted ribo-oligonucleotides. Furthermore, the term "nucleic acid sequence(s)/molecules(s)" also refers to any molecule that comprises nucleotides or nucleotide analogues. The term "nucleic acid sequence(s)/molecule(s)" can refer to deoxyribonucleic acid (DNA) and ribonucleic acid (RNA). The "nucleic acid sequence(s)/molecule(s)" may be made by synthetic chemical methodology known to one of ordinary skill in the art, or by the use of recombinant technology, or may be isolated from natural sources, or by a combination thereof. The DNA and RNA may optionally comprise unnatural nucleotides and may be single or double stranded. "Nucleic acid sequence(s)/molecule(s)" also refers to sense and anti-sense DNA and RNA, that is, a nucleotide sequence which is complementary to a specific sequence of nucleotides in DNA and/or RNA. Furthermore, the term "nucleic acid sequence(s)/molecule(s)" may refer to DNA or RNA or hybrids thereof or any modification thereof that is known in the state of the art (see, e.g., U.S. Pat. No. 5,525,711, U.S. Pat. No. 4,711,955, U.S. Pat. No. 5,792,608 or EP 302175 for examples of modifications). The nucleic acid molecule(s) may be single- or double-stranded, linear or circular, natural or synthetic, and without any size limitation. For instance, the nucleic acid molecule(s) may be genomic DNA, cDNA, mRNA, antisense RNA, ribozymal or a DNA encoding such RNAs or chimeroplasts (Colestrauss, Science (1996), 1386-1389. Said nucleic acid molecule(s) may be in the form of a plasmid or of viral DNA or RNA. "Nucleic acid sequence(s)/molecule(s)" may also refer to (an) oligo-nucleotide(s), wherein any of the state of the art modifications such as phosphothioates or peptide nucleic acids (PNA) are included.

Nucleic acid sequence with a certain level of identity to the herein provided human sequences can be identified by the skilled person using methods known in the art, e.g. by using hybridization assays or by using alignments, either manually or by using computer programs such as those mentioned herein below in connection with the definition of the term "hybridization" and degrees of homology.

The nucleic acid sequence may be at least 70% identical to the nucleic acid sequence as shown in SEQ ID NO. 2, 3, 8, 9, 11, 12, 15 or 16. More preferably, the nucleic acid sequence is at least 90%, 91%, 92%, 93%, 94%, 95%, 96%, 97% or 98% identical to the nucleic acid sequence as shown in SEQ ID NOs. 2, 3, 8, 9, 11, 12, 15 or 16, wherein the higher values are preferred. Most preferably, the nucleic acid sequence is at least 99% identical to the nucleic acid sequence as shown in SEQ ID NO. 2, 3, 8, 9, 11, 12, 15 or 16. These definitions apply, mutatis mutandis, to the nucleotide sequence(s) of the NRG1 gene, CD74 gene and/or MTSS1 gene as disclosed herein, for example, the gene of NRG1 having a nucleotide sequence as shown in NCBI Reference Sequence: NG_012005.1 (Gene ID: 3084; gi: 236459116) or a fragment thereof; the gene of CD74 having a nucleotide sequence as shown in NCBI Reference Sequence: NG_029730.1 (Gene ID: 972; gi:343488507) or a fragment thereof; or the gene of MTSS1 having a nucleotide sequence as shown in NCBI Reference Sequence NC_000008.10 (Gene ID: 9788; gi:224589820) or a fragment thereof.

Hybridization assays for the characterization of nucleic acids with a certain level of identity to the nucleic acid sequences as provided herein are well known in the art; see e.g. Sambrook, Russell "Molecular Cloning, A Laboratory Manual", Cold Spring Harbor Laboratory, N.Y. (2001); Ausubel, "Current Protocols in Molecular Biology", Green Publishing Associates and Wiley Interscience, N.Y. (1989). The term "hybridization" or "hybridizes" as used herein may relate to hybridizations under stringent or non-stringent conditions. If not further specified, the conditions are preferably non-stringent. Said hybridization conditions may be established according to conventional protocols described, e.g., in Sambrook (2001) loc. cit.; Ausubel (1989) loc. cit., or Higgins and Hames (Eds.) "Nucleic acid hybridization, a practical approach" IRL Press Oxford, Washington D.C., (1985). The setting of conditions is well within the skill of the artisan and can be determined according to protocols described in the art. Thus, the detection of only specifically hybridizing sequences will usually require stringent hybridization and washing conditions such as, for example, the highly stringent hybridization conditions of 0.1×SSC, 0.1% SDS at 65° C. or 2×SSC, 60° C., 0.1% SDS. Low stringent hybridization conditions for the detection of homologous or not exactly complementary sequences may, for example, be set at 6×SSC, 1% SDS at 65° C. As is well known, the length of the probe and the composition of the nucleic acid to be determined constitute further parameters of the hybridization conditions.

In accordance with the present invention, the terms "homology" or "percent homology" or "identical" or "percent identity" or "percentage identity" or "sequence identity" in the context of two or more nucleic acid sequences refers to two or more sequences or subsequences that are the same, or that have a specified percentage of nucleotides that are the same (at least 70%, 75%, 80%, 85%, most preferably at least 90%, 91%, 92%, 93%, 94%, 95%, 96%, 97% or 98% identity, most preferably at least 99% identity), when compared and aligned for maximum correspondence over a window of comparison (preferably over the full length), or over a designated region as measured using a sequence comparison algorithm as known in the art, or by manual alignment and visual inspection. Sequences having, for example, 75% to 90% or greater sequence identity may be considered to be substantially identical. Such a definition also applies to the complement of a test sequence. Preferably the described identity exists over a region that is at least about 15 to 25 nucleotides in length, more preferably, over a region that is at least about 50 to 100 nucleotides in length and most preferably, over a region that is at least about 800 to 1200 nucleotides in length, preferably over the full length. Those having skill in the art will know how to determine percent identity between/among sequences using, for example, algorithms such as those based on CLUSTALW computer program (Thompson Nucl. Acids Res. 2 (1994), 4673-4680) or FASTDB (Brutlag Comp. App. Biosci. 6 (1990), 237-245), as known in the art.

Although the FASTDB algorithm typically does not consider internal non-matching deletions or additions in sequences, i.e., gaps, in its calculation, this can be corrected manually to avoid an overestimation of the % identity. CLUSTALW, however, does take sequence gaps into account in its identity calculations. Also available to those having skill in this art are the BLAST and BLAST 2.0 algorithms (Altschul, (1997) Nucl. Acids Res. 25:3389-3402; Altschul (1993) J. Mol. Evol. 36:290-300; Altschul (1990) J. Mol. Biol. 215:403-410). The BLASTN program for nucleic acid sequences uses as defaults a word length (W) of 11, an expectation (E) of 10, M=5, N=4, and a comparison of both strands. The BLOSUM62 scoring matrix (Henikoff (1989) PNAS 89:10915) uses alignments (B) of 50, expectation (E) of 10, M=5, N=4, and a comparison of both strands.

In order to determine whether an nucleotide residue in a nucleic acid sequence corresponds to a certain position in the nucleotide sequence of e.g. SEQ ID NOs: 2, 3, 8, 9, 11, 12, 15 or 16, respectively, the skilled person can use means and methods well-known in the art, e.g., alignments, either manually or by using computer programs such as those mentioned herein. For example, BLAST 2.0, which stands for Basic Local Alignment Search Tool BLAST (Altschul (1997), loc. cit.; Altschul (1993), loc. cit.; Altschul (1990), loc. cit.), can be used to search for local sequence alignments. BLAST, as discussed above, produces alignments of nucleotide sequences to determine sequence similarity. Because of the local nature of the alignments, BLAST is especially useful in determining exact matches or in identifying similar sequences. The fundamental unit of BLAST algorithm output is the High-scoring Segment Pair (HSP). An HSP consists of two sequence fragments of arbitrary but equal lengths whose alignment is locally maximal and for which the alignment score meets or exceeds a threshold or cut-off score set by the user. The BLAST approach is to look for HSPs between a query sequence and a database sequence, to evaluate the statistical significance of any matches found, and to report only those matches which satisfy the user-selected threshold of significance. The parameter E establishes the statistically significant threshold for reporting database sequence matches. E is interpreted as the upper bound of the expected frequency of chance occurrence of an HSP (or set of HSPs) within the context of the entire database search. Any database sequence whose match satisfies E is reported in the program output.

Analogous computer techniques using BLAST (Altschul (1997), loc. cit.; Altschul (1993), loc. cit.; Altschul (1990), loc. cit.) are used to search for identical or related molecules in nucleotide databases such as GenBank or EMBL. This analysis is much faster than multiple membrane-based hybridizations. In addition, the sensitivity of the computer search can be modified to determine whether any particular match is categorized as exact or similar. The basis of the search is the product score, which is defined as:

$$\frac{\% \text{ sequence identity} \times \% \text{ maximum BLAST score}}{100}$$

and it takes into account both the degree of similarity between two sequences and the length of the sequence match. For example, with a product score of 40, the match will be exact within a 1-2% error; and at 70, the match will be exact. Similar molecules are usually identified by selecting those, which show product scores between 15 and 40, although lower scores may identify related molecules. Another example for a program capable of generating sequence alignments is the CLUSTALW computer program (Thompson (1994) Nucl. Acids Res. 2:4673-4680) or FASTDB (Brutlag (1990) Comp. App. Biosci. 6:237-245), as known in the art.

The explanations and definitions given herein above in respect of "homology/identity of nucleic acid sequences" apply, mutatis mutandis, to "amino acid sequences" of the herein provided fusion genes as depicted in SEQ ID NO: 1, 4, 5, 6, 7, 10, 13, 14 and 17 as explained below.

The polypeptide to be used in accordance with the present invention may have at least 70% identity/similarity to the proteins having the amino acid sequence as, for example, depicted in SEQ ID NO: 1, 4, 5, 6, 7, 10, 13, 14 and 17, respectively. More preferably, the polypeptide has at least 90%, 91%, 92%, 93%, 94%, 95%, 96%, 97% or 98% identity/similarity to the proteins depicted in SEQ ID NO: 21, 4, 5, 6, 7, 10, 13, 14 and 17, respectively, wherein the higher values are preferred. Most preferably, the polypeptide has at least 99% homology to the protein as depicted in 1, 4, 5, 6, 7, 10, 13, 14 and 17. These definitions apply, mutatis mutandis, to the amino acid sequence(s) of the NRG1 protein/isoform variants, CD74 protein/isoform variants and MTSS1 protein/variants, respectively, as disclosed herein.

Without deferring from the gist of the present invention also (functional) fragment or (functional) derivatives of the herein provided polypeptides or proteins can be used, for example, (functional) fragment(s) or (functional) derivative(s) of the fusion protein CD74-NRG1, such as the one as shown in SEQ ID NO: 1, of the fusion protein MTSS1-NRG1 such as the one as shown in SEQ ID NO: 10, or (functional) fragments) or (functional) derivative (a) of proteins comprising the polypeptide as shown in SEQ ID NOs: 4, 5, 6, 7, 13, 14 or 17.

Thus, a fragment of the above polypeptide(s)/protein(s) can be any of the above specific polypeptides as shown in SEQ ID NOs: 1, 4, 5, 6, 7, 10, 13, 14 or 17, wherein one or more amino acids are deleted.

A (functional) derivative(s) of the above polypeptide(s)/protein(s) can be any of the above specific polypeptides as shown in SEQ ID NOs: 1, 4, 5, 6, 7, 10, 13, 14 or 17, wherein one or more amino acids are inserted, added or substituted.

A fragment can consist of at least 3, 5, 10, 20, 30, 40, 50, 60, 70, 80, 90, 100, 110, 120, 130, 140, 150, 160, 170, 180, 190, 200, 210, 220, 230, 240, 250, 260, 270, and up to 280 contiguous amino acids of the amino acid sequence shown in SEQ ID NO: 1. A fragment can consist of at least 3, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 350, 400, 450, 500, 550, 600 and up to 640 contiguous amino acids of the amino acid sequence shown in SEQ ID NO: 4. A fragment can consist of at least 3, 5, 10, 20, 30, 40, 50, 60, 70, 80, 90, 100, 110, 120, 130, 140, 150, 160, 170, 180, 190, 200, 210, 220, and up to 230 contiguous amino acids of the amino acid sequence shown in SEQ ID NO: 5.

A fragment can consist of at least 3, 5, 10, 20, 30, 40, 50, 60, and up to 70 contiguous amino acids of the amino acid sequence shown in SEQ ID NO: 6. A fragment can consist of at least 3, 5, 10, 20, 30, 40, 50, 60, 70, 80, 90, 100, 110, 120, 130, 140, 150, 160, 170, 180, 190, and up to 200 contiguous amino acids of the amino acid sequence shown in SEQ ID NO: 7. A fragment can consist of at least 3, 5, 10, 20, 30, 40, 50, 60, 70, 80, 90, 100, 110, 120, 130, 140, 150, 160, 170, 180, 190, 200, 210, 220, 230, 240, 250, 260, and up to 270 contiguous amino acids of the amino acid sequence shown in SEQ ID NO: 10. A fragment can consist of at least 3, 5, 10, 20, 30, 40, 50, 60, 70, 80, 90, 100, 110, 120, 130, 140, 150, 160, 170, 180, 190, and up to 200 contiguous amino acids of the amino acid sequence shown in SEQ ID NO: 13. A fragment can consist of at least 3, 5, 10, 20, 30, 40, 50 and up to 60 contiguous amino acids of the amino acid sequence shown in SEQ ID NO: 14. A fragment can consist of at least 3, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 350, 400, 450, 500, 550, 600, 650, 700 and up to 750 contiguous amino acids of the amino acid sequence shown in SEQ ID NO: 17.

A (functional) derivative(s) of the above polypeptide(s)/protein(s) can be the polypeptide as shown in SEQ ID NO: 1, wherein at least 3, 5, 10, 20, 30, 40, 50, 60, 70, 80, 90, 100, 110, 120, 130, 140, 150, 160, 170, 180, 190, 200, 210, 220, 230, 240, 250, 260, 270, and up to 280 amino acid s are inserted, added or substituted. A (functional) derivative(s) of the above polypeptide(s)/protein(s) can be the polypeptide as shown in SEQ ID NO: 4, wherein at least 3, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 350, 400, 450, 500, 550, 600 and up to 640 amino acid s are inserted, added or substituted. A (functional) derivative(s) of the above polypeptide(s)/protein(s) can be the polypeptide as shown in SEQ ID NO: 5, wherein at least 3, 5, 10, 20, 30, 40, 50, 60, 70, 80, 90, 100, 110, 120, 130, 140, 150, 160, 170, 180, 190, 200, 210, 220, and up to 230 amino acid s are inserted, added or substituted. A (functional) derivative(s) of the above polypeptide(s)/protein(s) can be the polypeptide as shown in SEQ ID NO: 6, wherein at least 3, 5, 10, 20, 30, 40, 50, 60, and up to 70 amino acids are inserted, added or substituted. A (functional) derivative(s) of the above polypeptide(s)/protein(s) can be the polypeptide as shown in SEQ ID NO: 7, wherein at least 3, 5, 10, 20, 30, 40, 50, 60, 70, 80, 90, 100, 110, 120, 130, 140, 150, 160, 170, 180, 190, and up to 200 amino acid s are inserted, added or substituted. A (functional) derivative(s) of the above polypeptide(s)/protein(s) can the polypeptide as shown in SEQ ID NO: 10, wherein at least 3, 5, 10, 20, 30, 40, 50, 60, 70, 80, 90, 100, 110, 120, 130, 140, 150, 160, 170, 180, 190, 200, 210, 220, 230, 240, 250, 260, and up to 270 amino acid s are inserted, added or substituted. A (functional) derivative(s) of the above polypeptide(s)/protein(s) can the polypeptide as shown in SEQ ID NO: 13, wherein at least 3, 5, 10, 20, 30, 40, 50, 60, 70, 80, 90, 100, 110, 120, 130, 140, 150, 160, 170, 180, 190, and up to 200 amino acid s are inserted, added or substituted. A (functional) derivative(s) of the above polypeptide(s)/protein(s) can the polypeptide as shown in SEQ ID NO: 14, wherein at least 3, 5, 10, 20, 30, 40, 50, and up to 60 amino acid s are inserted, added or substituted. A (functional) derivative(s) of the above polypeptide(s)/protein(s) can the polypeptide as shown in SEQ ID NO: 17, wherein at least 3, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 350, 400, 450, 500, 550, 600, 650, 700 and up to 750 amino acid s are inserted, added or substituted.

The fragment or derivative preferably has the same (or essentially the same) biological activity as the full length polypeptide from which it is derived, the full length polypeptide having the amino acid sequence as shown in SEQ ID NO: 1, 4, 5, 6, 7, 10, 13, 14 or 17. In this sense, the fragment or derivative is a "functional" fragment or derivative to be used herein.

The herein provided polypeptide (as shown, for example, in SEQ ID NO: 1, 4, 5, 6, 7, 10, 13, 14 or 17) may have one or more amino acids deleted, inserted, added and/or substituted provided that the polypeptide maintains essentially the biological activity which is characteristic of the polypeptides from which it is derived.

Preferably, any such deletions, insertions, additions and/or substitutions (in this context particularly substitutions) are conservative, i.e. amino acids are substituted by amino acids having the same or similar characteristics. For example, a hydrophobic amino acid will preferably be substituted by another hydrophobic amino acid and so on.

The following relates to therapeutic uses of the present invention.

The present invention relates to a method for treating a patient with an inhibitor, said method comprising selecting a cancer patient, wherein a tumor cell or cancer cell of a sample of said patient is determined to have a fusion gene present in said sample, and administering to the patient an effective amount of an inhibitor, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" apply mutatis mutandis in this context.

"Inhibitors" to be used herein have been defined and explained above. These definitions and explanations apply, mutatis, mutandis, to the therapeutic uses of the present invention. For example, inhibitors to be used herein can be inhibitor of a member of the ERBB family (like an inhibitor of ERBB1, ERBB2, ERBB3 or ERBB4) or an inhibitor of a ligand of a member of the ERBB family (like an inhibitor of a ligand of ERBB1, ERBB2, ERBB3 or ERBB4), or an inhibitor of a component of a pathway activated by the ERBB receptor family, or an inhibitor of NRG1. NRG1 is a ligand of a member of the ERBB family. The use of an inhibitor of NRG1 for the methods and uses of the present invention is encompassed herein. Also included is the use of inhibitors of fusion proteins comprising NRG1 (or fragments or variants thereof) as provided and defined herein.

The present invention relates to a method for treating a patient with an inhibitor, said method comprising selecting a cancer patient, wherein a tumor cell or cancer cell of a sample of said patient is determined to have a fusion gene present in said sample, and administering to the patient an effective amount of an inhibitor, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) apply mutatis mutandis in this context.

The present invention relates to a method for treating a patient with an inhibitor, said method comprising selecting a cancer patient, wherein a tumor cell or cancer cell of a sample of said patient is determined to have a gene product of a fusion gene present in said sample, and administering to the patient an effective amount of an inhibitor, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" and "gene product" apply mutatis mutandis in this context.

The present invention relates to a method for treating a patient with an inhibitor, said method comprising selecting a cancer patient, wherein a tumor cell or cancer cell of a sample of said patient is determined to have a gene product of a fusion gene present in said sample, and administering to the patient an effective amount of an inhibitor, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The present invention relates to a method for treating a patient with an inhibitor, said method comprising selecting a cancer patient, wherein a tumor cell or cancer cell of a sample of said patient is determined to have an increased amount of a gene product of a fusion gene in said sample in comparison to a control, and administering to the patient an effective amount of an inhibitor, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" and "gene product" apply mutatis mutandis in this context.

The present invention relates to a method for treating a patient with an inhibitor, said method comprising selecting a cancer patient, wherein a tumor cell or cancer cell of a sample of said patient is determined to have an increased amount of a gene product of a fusion gene in said sample in comparison to a control, and administering to the patient an effective amount of an inhibitor, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The present invention relates to an inhibitor for use in treating a cancer patient, wherein a tumor cell or cancer cell of a sample of said patient has a fusion gene present in said sample, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The present invention relates to an inhibitor of a member of the ERBB family or an inhibitor of a ligand of a member of the ERBB family or an inhibitor of a component of a pathway activated by the ERBB receptor family or an inhibitor of NRG1, for use in treating a cancer patient, wherein a tumor cell or cancer cell of a sample of said patient has a fusion gene present in said sample, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The present invention relates to an inhibitor of a member of the ERBB family or an inhibitor of a ligand of a member of the ERBB family or an inhibitor of a component of a pathway activated by the ERBB receptor family, or an inhibitor of NRG1, for use in treating a lung cancer patient, wherein a lung tumor cell or lung cancer cell of a sample of said patient has a fusion gene or a gene product of a fusion gene present in said sample, wherein said fusion gene comprises a nucleic acid encoding an NRG1 protein or a fragment of said protein and wherein said fusion gene comprises a nucleic acid encoding a further protein or a fragment of said protein.

The definitions and explanations given herein above in relation to the teen "fusion gene" apply mutatis mutandis in this context.

The present invention relates to an inhibitor for use in treating a cancer patient, wherein a tumor cell or cancer cell of a sample of said patient has a fusion gene present in said sample, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) apply mutatis mutandis in this context.

The present invention relates to an inhibitor for use in treating a cancer patient, wherein a tumor cell or cancer cell of a sample of said patient has a gene product of a fusion gene present in said sample, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" and "gene product" apply mutatis mutandis in this context.

The present invention relates to an inhibitor for use in treating a cancer patient, wherein a tumor cell or cancer cell of a sample of said patient has a gene product of a fusion gene present in said sample, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The present invention relates to an inhibitor for use in treating a cancer patient, wherein a tumor cell or cancer cell of a sample of said patient has an increased amount of a gene product of a fusion gene in comparison to a control in said sample in said sample, wherein said fusion gene comprises a nucleic acid encoding an NRG1 protein or a fragment of said protein and wherein said fusion gene comprises a nucleic acid encoding a further protein or a fragment of said protein, preferably a CD74 protein or a fragment of said protein.

The definitions and explanations given herein above in relation to the term "fusion gene" and "gene product" apply mutatis mutandis in this context.

The present invention relates to an inhibitor for use in treating a cancer patient, wherein a tumor cell or cancer cell of a sample of said patient has an increased amount of a gene product of a fusion gene in comparison to a control in said sample in said sample, wherein said fusion gene comprises a nucleic acid encoding an NRG1 protein or a fragment of said protein and wherein said fusion gene comprises a nucleic acid encoding an MTSS1 protein or a fragment of said protein.

The definitions and explanations given herein above in relation to the term "fusion gene" (particularly "MTSS1-NRG1" fusion gene) and "gene product" (particularly of the "MTSS1-NRG1" fusion gene) apply mutatis mutandis in this context.

The terms "treatment", "treating" and the like are used herein to generally mean obtaining a desired pharmacological and/or physiological effect. The effect may be prophylactic in terms of completely or partially preventing a disease or symptom thereof and/or may be therapeutic in terms of partially or completely curing a disease and/or adverse effect attributed to the disease. The term "treatment" as used herein covers any treatment of a disease in a subject and includes: (a) preventing a disease related in a subject which may be predisposed to the disease; (b) inhibiting the disease, i.e. arresting its development; or (c) relieving the disease, i.e. causing regression of the disease. In particular, "treatment" comprises a "better response" as defined and explained herein above, such as a "complete response" or a more rapid tumor shrinkage as compared to "non-responders" (like patients having no fusion gene (or gene product thereof) present or lower levels of the gene product compared to the control).

An "individual", "patient" or "subject" for the purposes of the present invention includes both humans and other animals, particularly mammals, and other organisms. Thus, the methods are applicable to both human therapy and veterinary applications. Preferably, the "individual", "patient" or "subject" is a mammal, and most preferably the "individual", "patient" or "subject" is human.

The inhibitor may be administered as a single anti-tumor agent or in form of a combination therapy, for example, conventional therapies like surgery, radiotherapy and/or one or more additional chemotherapeutic agents. Surgery may comprise the step of partial or complete tumour resection, prior to, during or after the administration of the herein provided therapy of the responding individuals with one or more inhibitors. The inhibitors to be used herein may be administered in a neoadjuvant or adjuvant setting The therapy used in said combination therapy may be chemotherapy or an anti-hormonal therapy. The chemotherapy may be anthracycline/taxane chemotherapy, therapy with an anti-metabolite agents, therapy with an anti-hormonal compound, therapy with an anti-estrogen, therapy with a tyrosine kinase inhibitor, therapy with a raf inhibitor, therapy with a ras inhibitor, therapy with a dual tyrosine kinase inhibitor, therapy with taxol, therapy with taxane, therapy with doxorubicin, therapy with adjuvant (anti-) hormone drugs, and/or therapy with cisplatin and the like. The inhibitor may be administered by any one of a parenteral route, oral route, intravenous route, subcutaneous route, intranasal route or transdermal route.

Accordingly, the herein provided therapy of responding individuals with an inhibitor as defined herein (or a pharmaceutically acceptable salt, solvate and/or hydrate thereof) may be administered to a patient in need of such a treatment during or after a surgical intervention/resection of the cancerous tissue. Therefore, the present invention is useful in neoadjuvant therapy, i.e. the treatment with the herein defined combination therapy given to a patient/patient group in need thereof prior to surgery. It is also useful in adjuvant therapy (i.e. after surgery). In other words, the inhibitor may be administered in a neoadjuvant or adjuvant setting (in particular neoadjuvant or adjuvant treatment of cancer).

The pharmaceutical composition will be formulated and dosed in a fashion consistent with good medical practice, taking into account the clinical condition of the individual patient, the site of delivery of the pharmaceutical composition, the method of administration, the scheduling of administration, and other factors known to practitioners. The "effective amount" of the pharmaceutical composition for purposes herein is thus determined by such considerations.

The skilled person knows that the effective amount of pharmaceutical composition administered to an individual will, inter alia, depend on the nature of the compound.

For example, if said inhibitor is a small molecule, the total (pharmaceutically) effective amount of the inhibitor in the pharmaceutical composition administered orally per dose will be in the range of about 50 mg inhibitor per day to 1000 mg inhibitor per day of patient, although, as noted above, this will be subject to therapeutic discretion. More preferably, this dose is at least 50 mg inhibitor per day, and most preferably for humans between about 50 mg and 600 mg inhibitor per day. For example, an inhibitor may be administered at a dose of 15 mg/kg body weight per day. If given continuously, the inhibitor is typically administered at a dose rate of about 50 mg per day to about 600 mg per day. An intravenous bag solution may also be employed. The length of treatment needed to observe changes and the interval following treatment for responses to occur appears to vary depending on the desired effect. The particular amounts may be determined by conventional tests which are well known to the person skilled in the art. The length of treatment needed to observe changes and the interval following treatment for responses to occur appears to vary depending on the desired effect. The particular amounts may be determined by conventional tests which are well known to the person skilled in the art.

The administration of the herein provided compositions may, inter alia, comprise an administration twice daily, every day, every other day, every third day, every forth day, every fifth day, once a week, once every second week, once every third week, once every month, etc.

For example, if said compound is a (poly)peptide or protein the total pharmaceutically effective amount of pharmaceutical composition administered parenterally per dose will be in the range of about 1 µg protein/kg/day to 15 mg protein/kg/day of patient body weight, although, as noted above, this will be subject to therapeutic discretion. More preferably, this dose is at least 0.01 mg protein/kg/day, and most preferably for humans between about 0.01 and 1 mg protein/kg/day. If given continuously, the pharmaceutical composition is typically administered at a dose rate of about 1 µg/kg/hour to about 50 µg/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect. The particular amounts may be determined by conventional tests which are well known to the person skilled in the art.

Pharmaceutical compositions of the invention may be administered orally, rectally, parenterally, intracisternally, intravaginally, intraperitoneally, topically (as by powders, ointments, drops or transdermal patch), bucally, or as an oral or nasal spray.

Pharmaceutical compositions of the invention preferably comprise a pharmaceutically acceptable carrier. By "pharmaceutically acceptable carrier" is meant a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The pharmaceutical composition is also suitably administered by sustained release systems. Suitable examples of sustained-release compositions include semi-permeable polymer matrices in the form of shaped articles, e.g., films, or mirocapsules. Sustained-release matrices include polylactides (U.S. Pat. No. 3,773,919, EP 58,481), copolymers of L-glutamic acid and gamma-ethyl-L-glutamate (Sidman, U. et al., Biopolymers 22:547-556 (1983)), poly (2-hydroxyethyl methacrylate) (R. Langer et al., J. Biomed. Mater. Res. 15:167-277 (1981), and R. Langer, Chem. Tech. 12:98-105 (1982)), ethylene vinyl acetate (R. Langer et al., Id.) or poly-D-(−)-3-hydroxybutyric acid (EP 133,988). Sustained release pharmaceutical composition also include liposomally entrapped compound. Liposomes containing the pharmaceutical composition are prepared by methods known per se: DE 3,218,121; Epstein et al., Proc. Natl. Acad. Sci. (USA) 82:3688-3692 (1985); Hwang et al., Proc. Natl. Acad. Sci. (USA) 77:4030-4034 (1980); EP 52,322; EP 36,676; EP 88,046; EP 143,949; EP 142,641; Japanese Pat. Appl. 83-118008; U.S. Pat. Nos. 4,485,045 and 4,544,545; and EP 102,324. Ordinarily, the liposomes are of the small (about 200-800 Angstroms) unilamellar type in which the lipid content is greater than about 30 mol. percent cholesterol, the selected proportion being adjusted for the optimal therapy.

For parenteral administration, the pharmaceutical composition is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation.

Generally, the formulations are prepared by contacting the components of the pharmaceutical composition uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non aqueous vehicles such as fixed oils and ethyl oleate are also useful herein, as well as liposomes. The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) (poly)peptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

The components of the pharmaceutical composition to be used for therapeutic administration must be sterile. Sterility is readily accomplished by filtration through sterile filtration membranes (e.g., 0.2 micron membranes). Therapeutic components of the pharmaceutical composition generally are placed into a container having a sterile access port, for example, an intravenous solution bag or vial having a stopper pierceable by a hypodermic injection needle.

The components of the pharmaceutical composition ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous solution, and the resulting mixture is lyophilized. The infusion solution is prepared by reconstituting the lyophilized compound(s) using bacteriostatic Water-for-Injection.

Inhibitors for use in accordance with the present invention are described herein and refer generally to known and/or commercially available inhibitors. However, also the use of inhibitors yet to be generated or known compounds to be tested for their inhibiting activity is envisaged in context of the present invention.

Therefore, the present invention provides a method for assessing the activity of a candidate molecule suspected of being an inhibitor a member of the ERBB family or of a ligand thereof comprising the steps of:

(a) contacting a cell, tissue or a non-human animal comprising a member of the ERBB family with said candidate molecule;

(b) detecting a decrease in activity of a member of the ERBB family; and (c) selecting a candidate molecule that decreases activity of a member of the ERBB family; wherein a decrease of the activity is in particular indicative for the capacity of the selected molecule to be useful in the treatment of cancer.

Further, the present invention provides the use of a nucleic acid or antibody capable of detecting the presence of a fusion gene or the presence or amount of a gene product of the fusion as defined herein for the methods of the present invention, i.e. for assessing whether a patient suffers from cancer or is prone to suffering from cancer; or for predicting the responsiveness of a cancer or tumor cell (such as a mammalian cancer cell or mammalian tumor cell) or a responsive patient to an inhibitor as defined herein.

The oligonucleotide(s) may be about 15 to 100 nucleotides in length. A person skilled in the art is, based on his general knowledge and the teaching provided herein, easily in the position to identify and/or prepare (a) an oligo- or polynucleotide capable of detecting the presence of a fusion gene or the presence or amount of a gene product of the fusion as defined herein. These oligo- or polynucleotides may be used as probe(s) or primers in the methods provided herein.

A skilled person will know, for example, computer programs which may be useful for the identification of corresponding probes/primers to be used herein. For example, the nucleic acid sequence(s) of exemplary coding sequences as disclosed herein (SEQ ID NO: 2, 3, 8, 9, 11, 12, 15, 16 or 17) may be used in this context. Exemplary nucleic acid sequences (particularly of the genes of NRG1, CD74 or MTSS1) are provided herein and are also available on corresponding databases, such as the Ensemble database (http://www.ensembl.org/index.html) or NCBI.

Examplary oligonucleotides (primers) to be used in accordance with the present invention are

```
Forward:        CTTCCCGGAGAACCTGAGAC
and/or

Reverse:        ATCTCGAGGGTTTGAAAGG
```

Examplary oligonucleotides (probes) to be used in accordance with the present invention are the following BAC clones used for the break-apart FISH assay on NRG1:

Centromeric probes (labelled in red): RP11-1002K11 and RP11-35D16

Telomeric probes (labelled in green): RP11-23A12 and RP11-715M18

Furthermore, the present invention provides a kit useful for carrying out the methods of the invention, the kit comprising a nucleic acid or an antibody capable of detecting the presence of a fusion gene or the presence or amount of a gene product of the fusion as defined herein. Also envisaged herein is the use of the herein described kit for carrying out the herein provided methods.

For example, said kit may comprise (a) compound(s) required for specifically determining the presence of a fusion gene or the presence or amount of a gene product of the fusion as defined herein. Moreover, the present invention also relates to the use of (a) compound(s) required for specifically determining the presence of a fusion gene or the presence or amount of a gene product of the fusion as defined herein for the preparation of a kit for carrying out the methods of this invention. On the basis of the teaching of this invention, the skilled person knows which compound(s) is (are) required for specifically determining the presence of a fusion gene or the presence or amount of a gene product of the fusion as defined herein. For example, such compound(s) may be (a) "binding molecule(s)", like, for example, (a) "binding molecule(s)" Particularly, such compound(s) may be (a) (nucleotide) probe(s), (a) primer(s) (pair(s)), (an) antibody(ies) and/or (an) aptamer(s) specific for at least fusion gene as described herein or for a product thereof. The kit (to be prepared in context) of this invention may be a diagnostic kit.

The kit (to be prepared in context) of this invention may further comprise or be provided with (an) instruction manual(s). For example, said instruction manual(s) may guide the skilled person (how) to determine the (reference/control) expression level of a gene product of the fusion as defined herein and/or (how) to diagnose responsiveness to an inhibitor. Said instruction manual(s) may comprise guidance to use or apply the herein provided methods or uses. The kit (to be prepared in context) of this invention may further comprise substances/chemicals and/or equipment suitable/required for carrying out the methods and uses of this invention. For example, such substances/chemicals and/or equipment are solvents, diluents and/or buffers for stabilizing and/or storing (a) compound(s) required for specifically determining the presence of a fusion gene or the presence/amount of a fusion gene as defined herein.

As used herein, the terms "comprising" and "including" or grammatical variants thereof are to be taken as specifying the stated features, integers, steps or components but do not preclude the addition of one or more additional features, integers, steps, components or groups thereof. This term encompasses the terms "consisting of" and "consisting essentially of"

Thus, the terms "comprising"/"including"/"having" mean that any further component (or likewise features, integers, steps and the like) can be present.

The term "consisting of" means that no further component (or likewise features, integers, steps and the like) can be present.

The term "consisting essentially of" or grammatical variants thereof when used herein are to be taken as specifying the stated features, integers, steps or components but do not preclude the addition of one or more additional features, integers, steps, components or groups thereof but only if the additional features, integers, steps, components or groups thereof do not materially alter the basic and novel characteristics of the claimed composition, device or method.

Thus, the term "consisting essentially of" means that specific further components (or likewise features, integers, steps and the like) can be present, namely those not materially affecting the essential characteristics of the composition, device or method. In other words, the term "consisting essentially of" (which can be interchangeably used herein with the term "comprising substantially"), allows the presence of other components in the composition, device or method in addition to the mandatory components (or likewise features, integers, steps and the like), provided that the essential characteristics of the device or method are not materially affected by the presence of other components.

The term "method" refers to manners, means, techniques and procedures for accomplishing a given task including, but not limited to, those manners, means, techniques and procedures either known to, or readily developed from known manners, means, techniques and procedures by practitioners of the chemical, biological and biophysical arts.

As used herein, the term "isolated" refers to a composition that has been removed from its in-vivo location. Preferably the isolated compositions or compounds of the present invention are substantially free from other substances (e.g., other proteins or other compounds) that are present in their in-vivo location (i.e. purified or semi-purified compositions or compounds.)

As used herein the term "about" refers to ±10%.

The present invention is further described by reference to the following non-limiting figures and examples.

Unless otherwise indicated, established methods of recombinant gene technology were used as described, for example, in Sambrook, Russell "Molecular Cloning, A Laboratory Manual", Cold Spring Harbor Laboratory, N.Y. (2001)) which is incorporated herein by reference in its entirety.

The Figures show:

FIG. 1. Identification of CD74-NRG1 fusion gene.

(a) Overview of driver genes detected in a cohort of 25 pan-negative lung AD of never smokers (the sequence identifiers of these driver genes, in descending order, are SEQ ID NO:25, SEQ ID NO:26, SEQ ID NO:27, SEQ ID NO:28, SEQ ID NO:29, SEQ ID NO:30, SEQ ID NO:31, SEQ ID NO:32, and SEQ ID NO:33. (b) Detection of CD74-NRG1 fusion transcript by transcriptome sequencing. (c) NRG1 break-apart FISH (left, break-apart signals indicated by arrows) and CD74-NRG1 fusion assay FISH (right, fusion signal indicated by the arrow) (d) Detection of CD74-NRG1 fusion gene by targeted genome sequencing.

Figure 2:
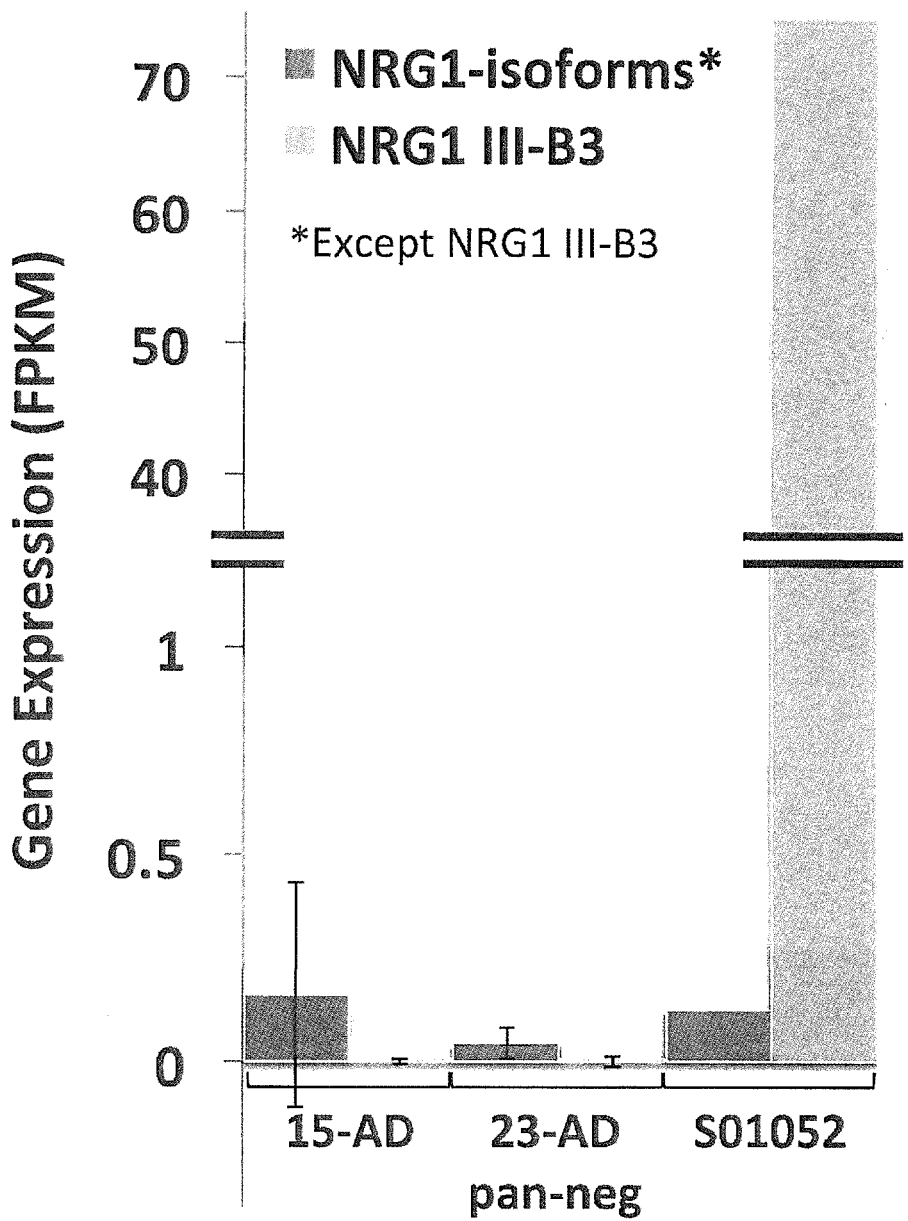
Figure 2:
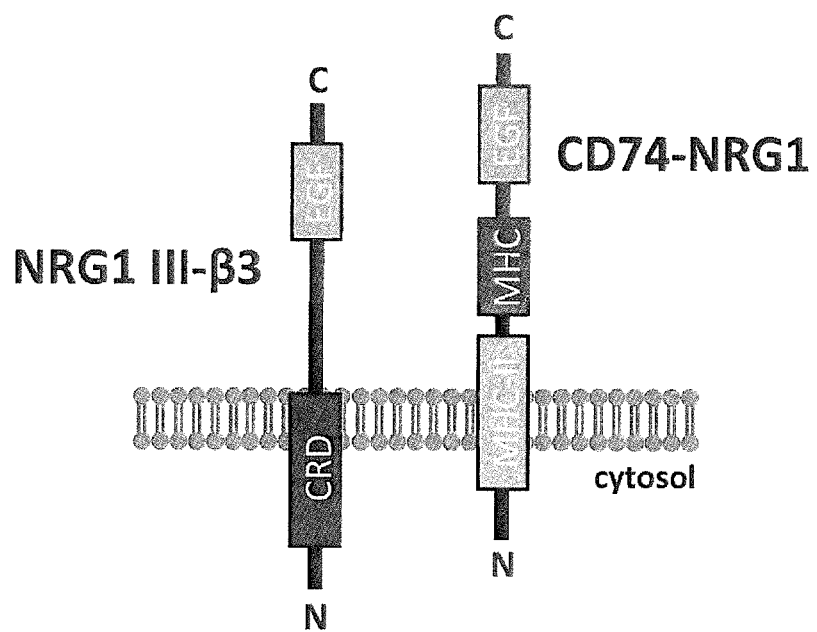
Figure 2:
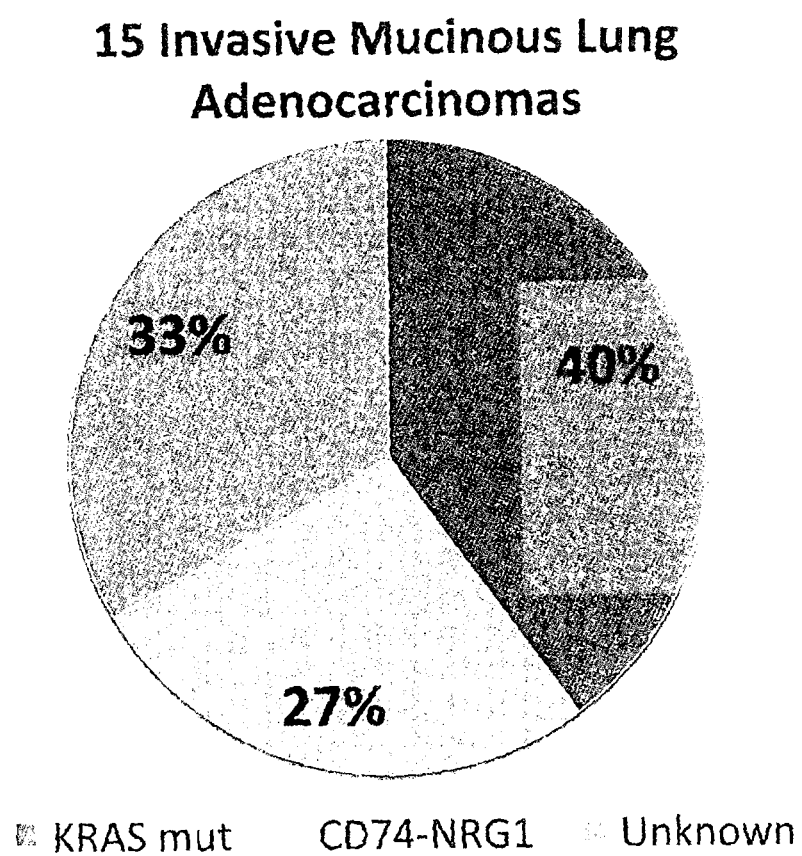
Figure 2:
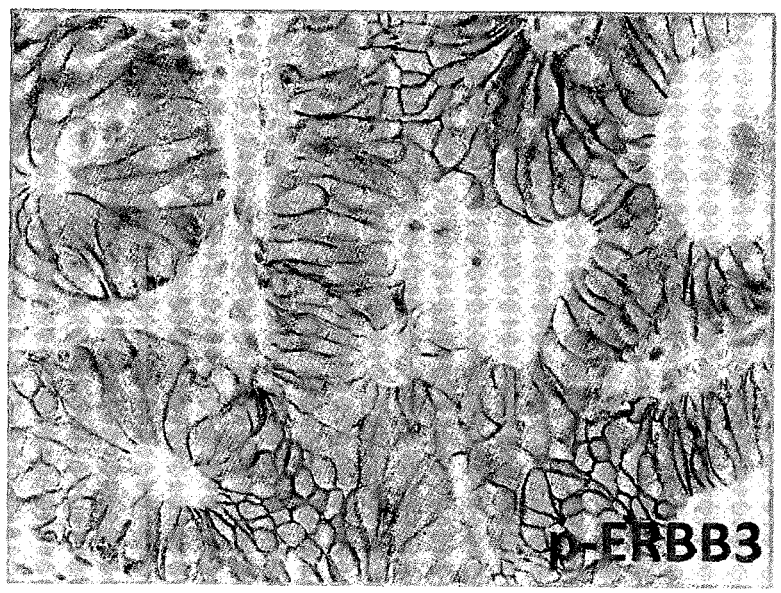
Figure 2:
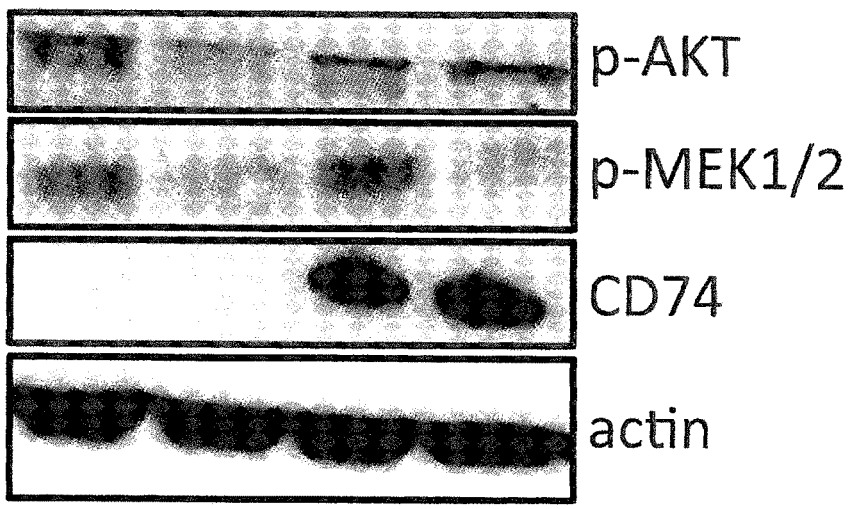

FIG. 2. Functional impact of CD74-NRG1, and association with IMC lung AD.

(a) Expression levels of NRG1 isoforms in lung AD and in the index case. (b) Schematic representation of wild type NRG1 III-β3 and CD74-NRG1 in the cellular membrane. (c) Frequency of KRAS-mutations and CD74-NRG1 rearrangements in IMC lung AD. (d) p-ERBB2 and p-ERBB3 staining on positive CD74-NRG1 cases. (e) Impact of CD74-NRG1 on the activation of PI3K-AKT pathway under starvation showed by WB of H2052 parental and CD74-NRG1-transduced cells, with and without FBS.

FIG. 3. Identification of the MTSS1-NRG1 fusion event in small cell lung cancer.

The MTSS1-NRG1 fusion event was detected in a small cell lung cancer sample (S02241) by transcriptome sequencing (RNAseq).

FIG. 4.

a) Schematic representation of the MTSS1-NRG1 translocation: The detected gene fusion event implies a genomic intra-chromosomal rearrangement resulting in the fusion of MTSS1 (exon 3) with NRG1 (exon 2) (the depicted nucleotides sequences, in descending order, are SEQ ID NO:34, SEQ ID NO:34, SEQ ID NO:35, SEQ ID NO:36, and SEQ ID NO:37. The nucleotide sequence of this translocation was validated on the cDNA sequence of this sample by Sanger sequencing.

b) Schematic representation of the putative MTSS1-NRG1 fusion protein: The validated nucleotide sequence of the MTSS1-NRG1 translocation would result in an in-frame fusion event in which the aminoterminal end of MTSS1

(amino acid (AA)1-70) is fused to NRG1. The respective protein domains involved in this fusion event are indicated.

Figure 5:
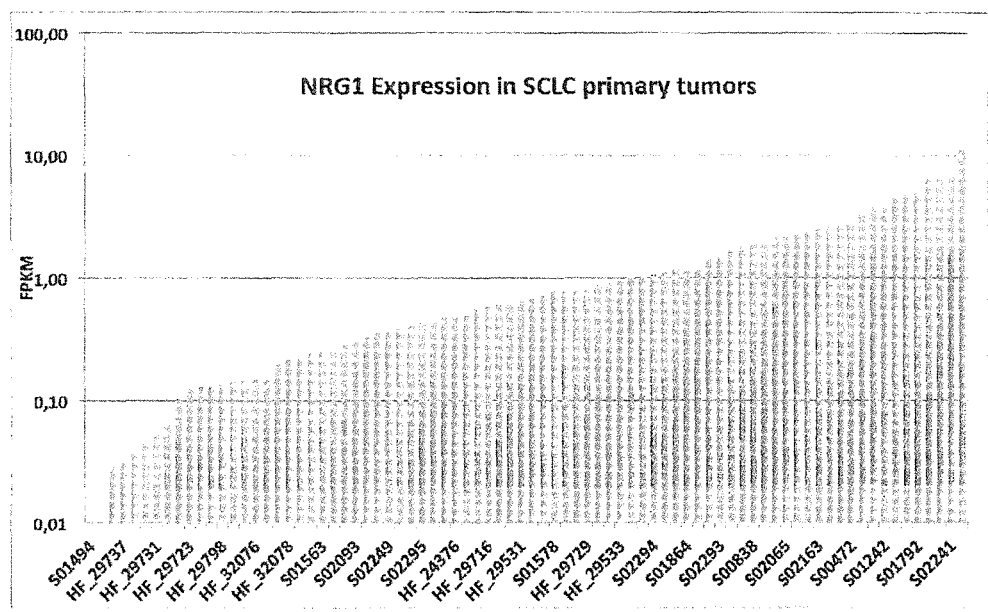

FIG. 5. NRG1 Expression in SCLC primary tumors.

Transcriptome sequencing on SCLC primary tumors reveals the overall expression pattern of the NRG1 gene. The sample with the translocation the MTSS1-NRG1 fusion event shows the second highest expression of NRG1 across of SCLC samples analyzed.

FIG. 6.

(Left panel) Intracellular (left) and extracellular (right) staining of CD74 in CD74-NRG1 transduced NIH-3T3 cells, detected by flow cytometry. (Right panel) Extracellular staining of NRG1 in CD74-NRG1 transduced NIH-3T3 cells, detected by flow cytometry. The % of Max is the number of cells in each bin divided by the number of cells in the bin that contains the largest number of cells.

FIG. 7.

(Left panel) Expression levels of ERBB receptors in the index case inferred from transcriptome sequencing data. FPKM values are shown. (Right panel) p-ERBB3 antibody was used to stain a tissue microarray composed of 241 lung adenocarcinomas. The frequency of p-ERBB3 positive cases in this cohort versus the 5 CD74-NRG1 positive samples is shown (p-value<0.0001).

FIG. 8.

Quantification of colonies and representative pictures of anchorage-independent growth of H1568 (a) and H2052 (b) cells transduced with empty vector (e.V.) or CD74-NRG1.

FIG. 9.

(a) Western-blot of H322 and H1568 transduced with e.V. or CD74-NRG1, after 24 h starvation. (b) Western-blot of H322 and H1568 transduced with e.V., CD74-NRG1, or a truncated form of the fusion lacking the EGF-like domain, after 24 h starvation.

Figure 10:
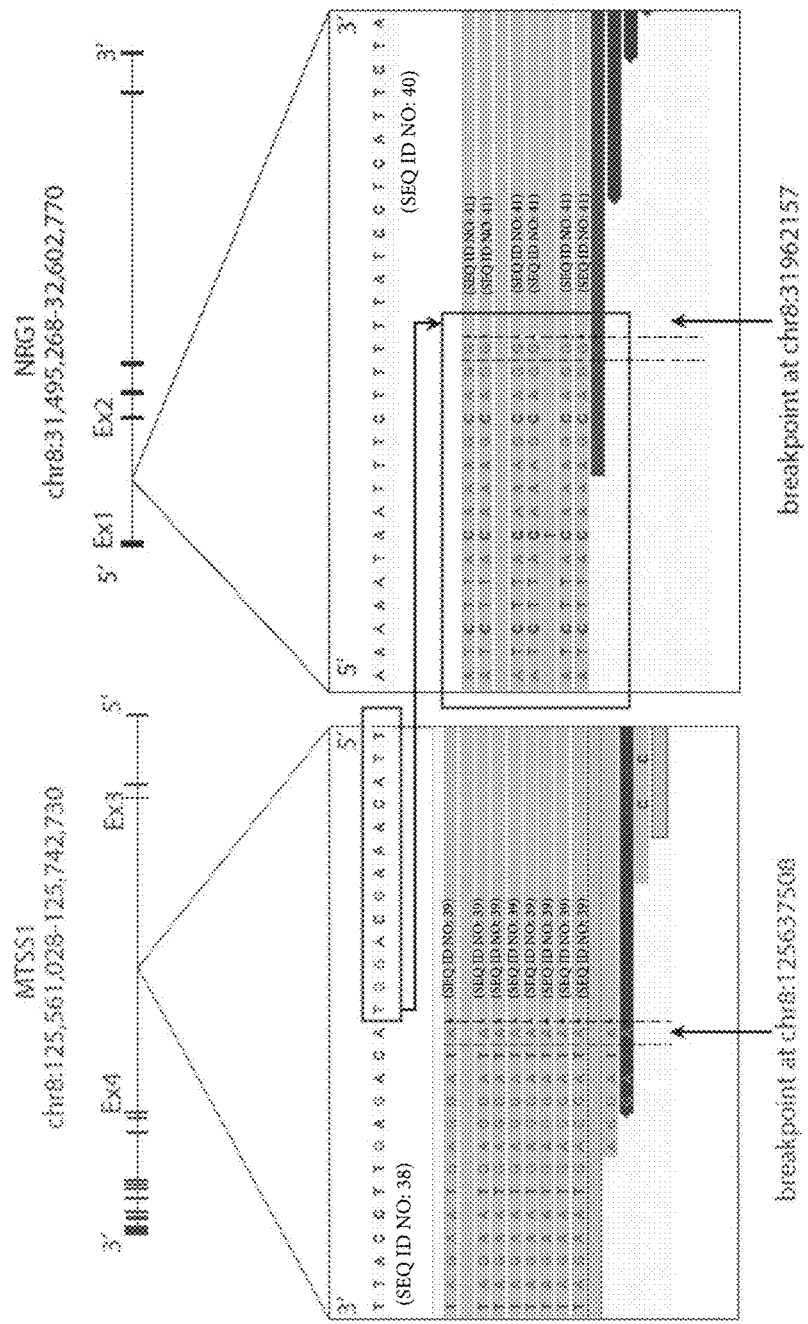

FIG. 10. Genomic translocation event of MTSS1-NRG1

The genomic rearrangement of the MTSS1-NRG1 fusion event was determined by whole genome sequencing. The sequencing reads spanning the translocation breakpoint partially map back to the two distinct regions on chromosome 8 of the reference human genome. The chromosomal breakpoint is determined to occur in the intron regions of MTSS1 and NRG1 at position chr8:125637508 and chr8:31962157, respectively. The gene region of MTSS1 comprising exon 1 to 3 is thus fused to the gene region of NRG1 upstream of exon 2 (red boxes).

Figure 11:
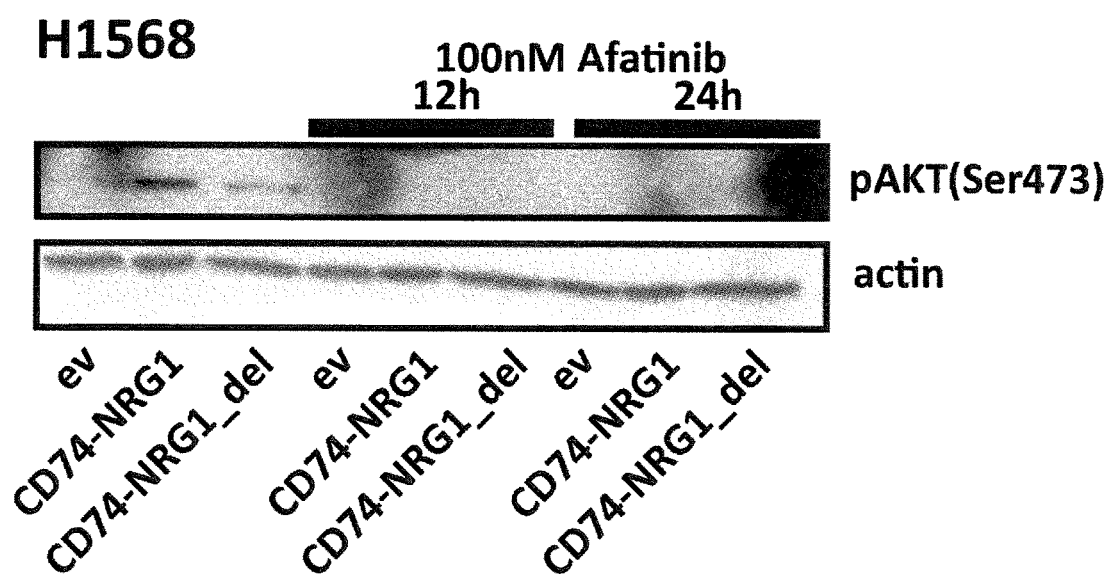

FIG. 11. Western Blot showing Afatinib treatment for 12/24 h

Immunoblot analysis phospho-AKT(Ser473) of H1568 cells transduced with empty vector control, CD74-NRG1 or CD74-NRG1_del (truncated version of CD74-NRG1 lacking EGF-like domain of NRG1, serving as the biological control) and treated with 100 nM Afatinib for 0 h, 12 h or 24 h.

The Examples illustrate the invention.

EXAMPLE 1: IDENTIFICATION OF CD74-NRG1, A NEW RECURRENT FUSION GENE IN INVASIVE MUCINOUS LUNG ADENOCARCINOMAS OF NEVER SMOKERS

Material and Methods
1. Primers Used for the Validation of the Fusion Gene from the cDNA of the Primary Tumor Around the Fusion Point:

```
Forward:    CTTCCCGGAGAACCTGAGAC

Reverse:    ATCTCGAGGGGTTTGAAAGG
```

2. Primers Used for the Amplification of the Fusion Gene from the cDNA of the Primary Tumor.

Restriction sites were added for clonal purposes:

```
CD74-NRG1_BamH1_F:
ctatGGATCCATGCACAGGAGGAG

CD74-NRG1-SalI_R:
gatcGTCGACCTATTCAGGCAGAGACAGAAAGGG
```

3. BAC Clones Used for the Break-Apart FISH Assay on NRG1

Centromeric probes (labelled in red): RP11-1002K11 and RP11-35D16

Telomeric probes (labelled in green): RP11-23A12 and RP11-715M18

4. Sample Preparation, DNA, RNA Extraction, and Illumina Sequencing

Sample preparation, DNA and RNA extraction was performed as previously described.(18) RNAseq was performed on cDNA libraries prepared from PolyA+ RNA extracted from tumor cells using the Illumina TruSeq protocol for mRNA. The final libraries were sequenced with a paired-end 2×100 by protocol aiming at 8.5 Gb per sample, resulting on a 30× mean coverage of the annotated transcriptome. All the sequencing was carry on an Illumina HiSeq™ 2000 sequencing instrument (Illumina, San Diego, Calif., USA).

5. Overview RNAseq Pipeline

For the analysis of RNAseq data, a pipeline (termed "TRUP" herein) was established that affords accurate and efficient mapping and downstream analysis of transcribed genes in cancer samples. Briefly, paired-end RNAseq reads are aligned against the human reference genome using spliced mappers such as TopHat or GSNAP. Unique paired-end alignments that are within the expected mapping distance are used to estimate the transcriptional abundance of annotated genes or exons and are used to reconstruct alternatively spliced isoforms of known genes using Cufflinks. By contrast, uniquely aligning read pairs that are not in accordance with the expected mapping distance in combination with singleton reads (i.e., only one end can be mapped) are selected for a de-novo assembly using Velvet and Oases. The aim for this procedure is to accurately reconstruct rearranged transcripts. By comparing the assembled transcripts with the Refseq-database and with the reference genome, we query for those candidates that show a partial alignment onto two different genes. These alignments are thereby representing a putative chimeric transcript. For each candidate, fusion-point spanning reads from the initially unmapped read pairs are detected to localize the breakpoint within the transcript. To allow confident predictions of chimeric transcripts, candidate chimeras are subsequently filtered by their read distribution around the potential fusion point. Finally fusion candidates were chosen for experimental validation where at least one read-pair is uniquely mapped to the human genome (to the two different genes), at least one 95 bp read unambiguously spanned a junction between two exons of the two genes, and the coverage is at least 5×.

6. Immunohistochemistry (IHC)

IHC was performed as previously described. (21) In brief, the tissue samples was stained with p-ERBB2 (Tyr1221/1222, Cell Signaling Technology, USA) and total ERBB1 (EGFR) (Dako, Germany) at a dilution of 1:1000 and 1:50 respectively. The Zeiss MIRAK DESK scanner was used to digitize the stained tissue. Staining for p-EGFR (Tyr1068, Cell Signaling Technology, USA) and p-ERBB3 (Tyr1289, Cell Signaling Technology, USA) were processed with an automated stainer (Autostainer, Dako Copenhagen, Denmark), using FLEX+ detection system (Dako).

7. Cell Culture

H2052, H322, and H1568 cells were obtained from American Type Culture Collection (ATCC) and maintained in RPMI-1640 medium (Life Technologies) supplemented with 10% fetal calf serum (FCS) (Gibco) and 1% penicillin-streptomycin(Gibco). The cells were cultured in a humidified incubator with 5% $CO_2$ and 37° C. For Western-blot experiments cells were serum starved without FCS for 24 h. NIH-3T3 cells were maintained accordingly but in DMEM medium (Life Technologies).

8. FACS Analysis

H2052 cells were obtained from ATCC. H2052 lung cells and NIH-3T3 mouse fibroblast cells were transduced with retrovirus containing CD74-NRG1. Parental, empty-vector, and CD74-NRG1 transduced cells (200 000) were washed in FACS-Buffer (PBS, 2% FCS) and fixed in 4% PFA for 30 min at room temperature. For permeabilization, cells were washed twice in Saponin-Buffer (PBS, 0.5% Saponin, 2% FCS) and intracellular staining of CD74-NRG1 was performed with anti-human-CD74-PE (BioLegend) 1:100. Extracellular staining was performed prior permeabilization, also with anti-human-CD74-PE (BioLegend) 1:100 or with anti-human-NRG1-PE (RnD Systems 1:25). Cells were analyzed on a BD LSR II (Beckman Coulter) and quantification was assessed with FlowJo (Treestar).

9. Western-Blot

Immunoblotting was performed using standard procedures. The following antibodies were obtained from Cell Signaling Technology: p-AKT Thr308 (Catalog No. #2975), p-AKT Ser473 (Catalog No. #9271), p-P70/S6 (Catalog No. #9205), total ERBB2 (Catalog No. #2242), p-ERBB2 (Catalog No. #2243), total ERBB3 (Catalog No.#4754) and p-ERBB3 (Catalog no. #4791). Anti human CD74 was obtained from Abeam (Catalog No. #ab22603), anti polyclonal NRG1 beta 1 was obtained from R&D Systems (Catalog No. AF396-NA). Actin-HRP antibody was obtained from SantaCruz (Catalog No. #sc47778). The antibodies were diluted in 5% BSA/TBST and incubated at 4° C. overnight. Proteins were detected with HRP-conjugated anti mouse, anti goat or anti-rabbit antibodies (Millipore) using ECL reagent (GE Healthcare).

10. Colony Formation Assay

On a layer of bottom agar (1%) the cells were suspended at low density in top agar (0.5%) containing 10% FCS, and were grown for 14 days. Subsequently pictures were taken and systematic analyses were performed with the Scanalyzer (LemnaTec).

Results

Transcriptome sequencing of lung adenocarcinomas (AD) of never smokers led to the identification of CD74-NRG1, a fusion gene further detected in 27% of invasive mucinous ADs. CD74-NRG1 induces the expression of the EGF-like domain of NRG1 providing the ligand for ERBB3 receptors that leads to the activation of the PI3K-AKT pathway. Thus, presence of CD74-NRG1 offers a therapeutic opportunity for a lung tumor subtype with, so far, no effective treatment.

Lung adenocarcinoma (AD) of patients who have never smoked frequently bear targetable genome kinase alterations, such as EGFR mutations and translocations affecting ALK, ROS1, and RET genes.[1-5] These mutations correlate with kinase inhibitor sensitivity in mouse models or in patients; for instance, patients with EGFR-mutant lung cancer treated with EGFR inhibitors show a progression free survival twice longer than patients treated with conventional chemotherapy.[6] Similarly, inhibition of ALK and ROS1 kinase activity induces clinically relevant remissions in patients bearing the respective genomic fusion.[7-9] Unfortunately, therapeutically relevant kinase alterations are not present in all lung cancer specimens. Thus, additional genome alterations need to be discovered in order to provide a therapeutic opportunity for the remaining patients. Indeed, although the recent increased on sequencing efforts, there is still about 40% of AD carrying unknown clinically relevant alterations[1].

Therefore, a cohort of 25 AD tumor specimens of never smokers was collected lacking mutations in KRAS or EGFR, in which chromosomal gene copy number analysis as well as transcriptome sequencing was performed with the aim of identifying new oncogenic driver genes (Supplementary Table 1). Ten of the samples analyzed carried a known oncogene: one sample harbored an EGFR amplification, paralleled by overexpression of the gene (FIG. 1a); and in 9 cases known kinase fusions affecting ALK, ROS1 and RET genes were identified (FIG. 1a). Interestingly, one sample was detected carrying a novel chimeric transcript fusing the first six exons of CD74 to the EGF-like domain of the NRG1 III-β3 isoform (FIGS. 1a and b). By CD74-NRG1 fusion assay and NRG1 break-apart FISH, the fusion gene was confirmed at the genomic level (FIG. 1c), as well as its absence in the adjacent normal cells. These results were further confirmed by targeted genome sequencing of the tumor sample, allowing the identification of the exact genomic break-point position (FIG. 1d).

Figure 6:
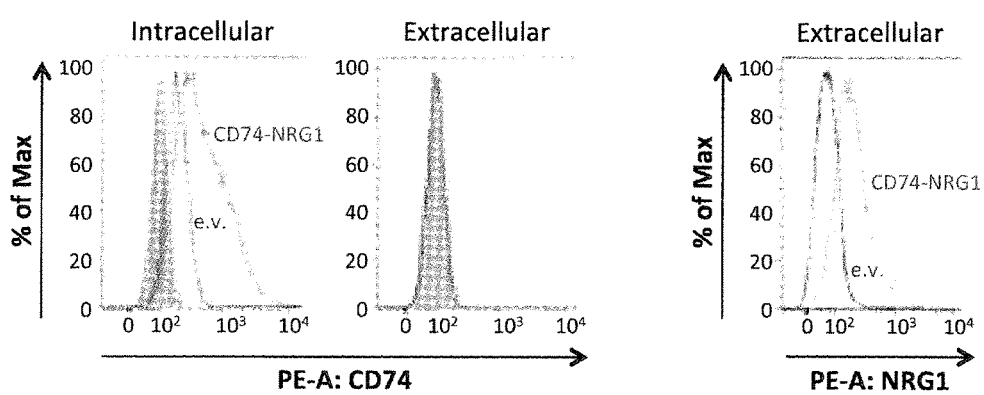

Neuregulins (NRGs) provide the ligand for ERBB3 and ERBB4 (NRG1 and NRG2) or only ERBB4 (NRG3 and NRG4).[10] The ERBB family of proteins comprises four receptors (ERBB1-4) and 13 polypeptide extracellular ligands, which contain a conserved epidermal growth factor (EGF) domain. Ligand binding to ERBB receptors induces receptor homo- and heterodimerization and consequent activation of the intrinsic kinase domain, mainly transducing the signal via the MAPK and the PI3K-AKT pathways.[10] The 31 NRG1 isoforms so far identified are divided in 6 major families[11]; the NRG1 present in the herein provided fusion gene belongs to the type III and carries the EGF-like domain type β, which has significantly greater affinity to the receptors than the α-type[12]. NRG1 type III expression is mostly limited to neurons, being the only isoform displaying this degree of restricted expression[13,14]. Interestingly, only the sample carrying the CD74-NRG1 fusion gene showed a high expression of NRG1 III-β3 isoform (74 FPKM, fragments per kilobase per million reads), a gene otherwise not expressed in this tumor type (FIG. 2a). Another characteristic unique to type III NRG1 is that they have cytosolic N-termini and membrane-tethered EGF-like domains.[x] Moreover, NRG1 III-β3 isoform lacks the TM-(transmembrane) domain C-terminal of the EGF-like domain, suggesting a juxtacrine (direct contact) rather than paracrine signaling.[15] In the case of CD74-NRG1, the part of CD74 substitutes the TM domain present in the wild-type NRG1 III-β3, preserving the membrane-tethered EGF-like domain as suggested by an intracellular CD74-positive staining of CD74-NRG1 transduced H2052 and NIH-3T3 cells, detected by flow cytometry (FIG. 2b and FIG. 6). By means of reverse-transcriptase polymerase chain reaction (RT-PCR) the presence of the fusion in four additional cases out of 94 pan-negative ADs of never smokers was confirmed (Supplementary Table 2). In total, all 5 cases were identified in stage I invasive mucinous lung adenocarcinomas (IMC) of never smoker females. This tumor type frequently presents with multifocal unresectable disease, for which no effective treatment has been yet established. This tumor subtype is highly associated with KRAS mutations[16]; indeed, out of 15 IMC (Asian population), 6 carried a KRAS mutation (40%), and 4 the CD74-NRG1 fusion (27%) (FIG. 2c). Additionally other lung tumor subtypes (70 cases), as well as 4 other cancer types (21 cases) were tested and found all being negative for the fusion gene (Supplementary Table 3), suggesting a strong link between presence of CD74-NRG1 and IMC.

Figure 7:
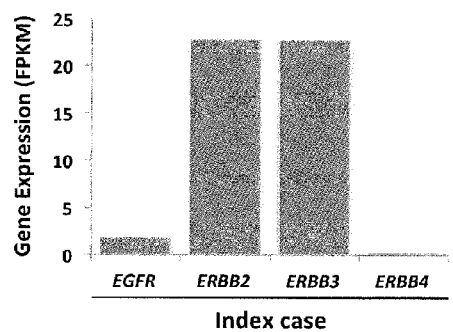
Figure 8:
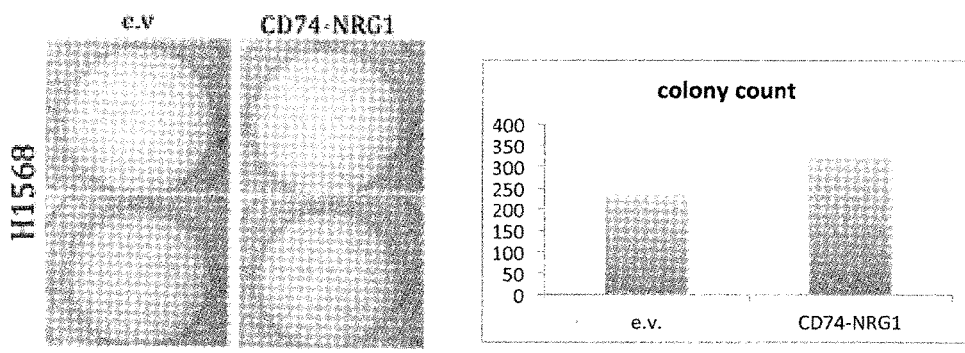
Figure 8:
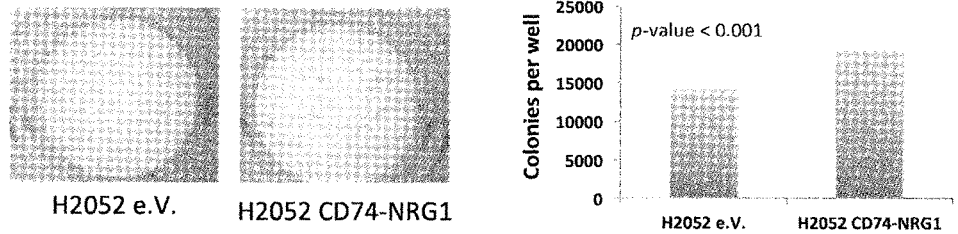
Figure 9:
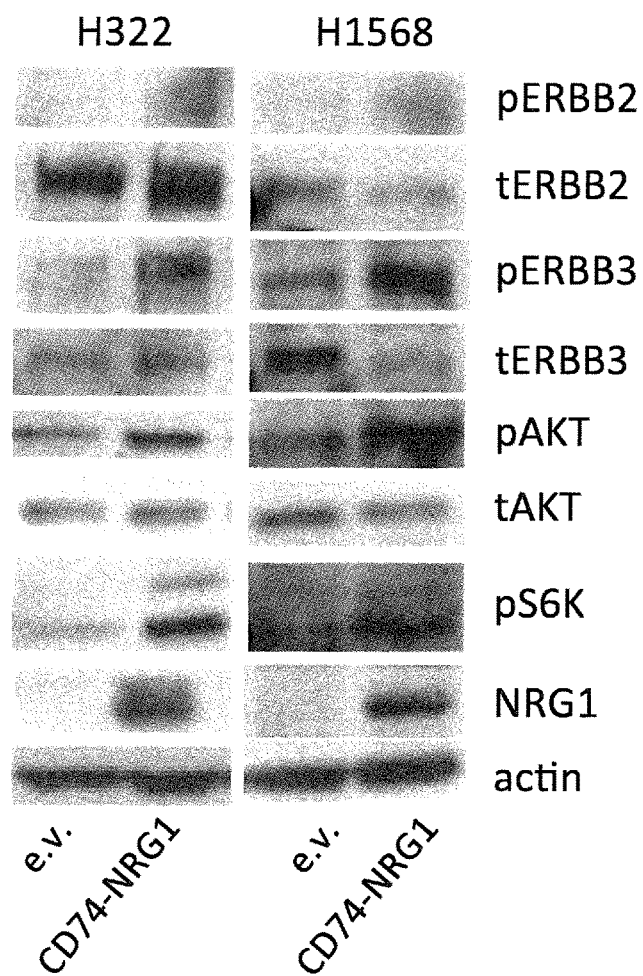
Figure 9:
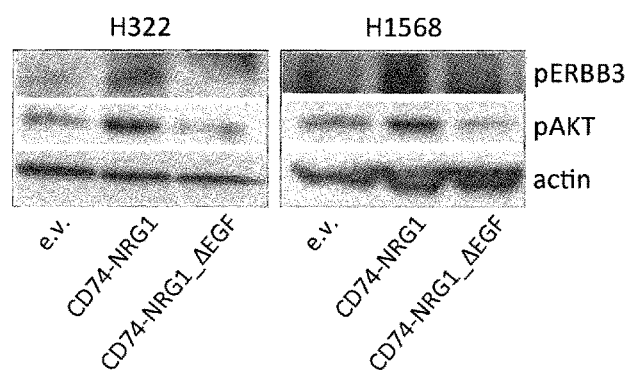

Given the fact that NRG1 signals through ERBB3-ERBB4 receptors, it was aimed to determine for which of them CD74-NRG1 provides the ligand. It was observed that ERBB4 was not expressed in the index case (0.2 FPKM), while ERBB3 was relatively highly expressed (22.8 FPKM) (FIG. 7, left panel; Supplementary Table 4). ERBB3 expression also correlated with a positive phospho-ERBB3 (p-ERBB3) signal in the tumoral tissue of the index case (FIG. 2d); in fact, the 5 cases carrying CD74-NRG1 fusion gene were positive for p-ERBB3 in contrast to a cohort of 241 ADs where p-ERBB3 was only detected in 6 of the samples (p-value<0.01, FIG. 7, right panel). Additionally, although both EGFR and ERBB2 were expressed in the index case (1.9 and 22.9 FPKM respectively, Supplementary Table 4), only ERBB2 expression correlated with a p-ERBB2 positive signal (FIG. 2d). These data suggest that CD74-NRG1 might provide the ligand for ERBB3, which may form heterodimers with ERBB2, since ERBB3 is devoid of intrinsic kinase activity, and cannot support linear signaling in isolation. This is in line with previous studies showing that NRG1 induces an oncogenic signal through ERBB2-ERBB3 heterodimers engaging the PI3K-AKT pathway.[17] These data was further supported by the activation of the PI3K-AKT but not the MAPK pathway, observed in CD74-NRG1 transduced H2054 cells, after 24 h starvation (FIG. 2e). We also transduced different cells with retroviruses encoding CD74-NRG1 and performed western-blots under starvation conditions, as well as colony formation assays. We used H322 and H1568 lung cancer cell lines expressing normal ERBB2 and ERBB3 levels, and transduced them with an empty vector, a plasmid containing the full fusion transcript, or a plasmid containing a truncated version of the fusion lacking the EGF-like domain. We observed that H322 and H1568 cell-lines transduced with the CD74-NRG1 showed increased levels of p-ERBB2, p-ERBB3, p-AKT, and p-S6K when comparing with the empty vector control (FIG. 9a). Furthermore, both p-ERBB3 and p-AKT were abrogated by loss of the EGF-like domain of CD74-NRG1 (FIG. 9b). Soft agar experiments with H1568 (FIG. 8a) and H2052 (FIG. 8b) cells showed an increase on colony formation when comparing with control cells, supporting the oncogenic effect of CD74-NRG1.

Altogether, these data show that CD74-NRG1 is a new recurrent oncogenic fusion gene, highly associated with invasive mucinous lung adenocarcinomas of never smokers.—The data also suggest that CD74-NRG1 fusion protein might signal through the ERBB2-ERBB3 receptors complex leading to the activation of the PI3K-AKT pathway, providing a therapeutic opportunity[19] for a tumor type with, so far, no effective treatment.

SUPPLEMENTARY TABLE 1

Sample table

| SAMPLE_INFO | | | | CLINICAL_DATA | | | |
|---|---|---|---|---|---|---|---|
| Sample_ID | Classification | Age | Sex | Stage_UICC | Survival_months | Survival_censor | Smoking |
| S00214 | AD | 63 | female | Ia | 51 | alive | never |
| S00545 | AD | 68 | female | IIIb | NA | NA | never |
| S00557 | AD | 72 | female | IV | 3 | alive | never |
| S00585 | AD | 74 | male | IV | 20 | dead | never |
| S00611 | AD | 50 | female | IV | 2 | dead | never |
| S00664 | AD | 56 | female | IIIb | 169 | dead | never |
| S00684 | AD | 70 | female | Ia | 172 | alive | never |
| S00686 | AD | 68 | male | Ia | 152 | dead | never |
| S00687 | AD | 60 | female | Ia | 178 | alive | never |
| S00688 | AD | 46 | female | Ia | 155 | alive | never |
| S00726 | AD | 79 | female | IIa | 64 | alive | never |
| S00737 | AD | 72 | male | IV | 1 | alive | never |
| S00738 | AD | 59 | male | Ib | 158 | alive | never |
| S00747 | AD | 63 | female | IIIa | 28 | dead | never |
| S00751 | AD | 65 | female | IIa | 57 | dead | never |
| S00752 | AD | 48 | male | IIIb | 34 | dead | never |
| S00754 | AD | 39 | female | IIIa | 17 | dead | never |
| S00755 | AD | 71 | female | IIIa | 35 | dead | never |
| S01052 | AD | 64 | female | Ib | 14 | alive | never |
| S01156 | AD | 74 | female | IIIa | 9 | dead | never |
| S01194 | AD | 73 | male | Ib | 42 | alive | never |
| S01272 | AD | 80 | female | Ib | 82 | alive | never |
| S01276 | AD | 66 | female | IIIb | 35 | alive | never |
| S01337 | AD | 66 | female | IIIa | 11 | alive | never |
| S01465 | AD | 75 | male | Ia | 9 | alive | never |

SUPPLEMENTARY TABLE 2

Recurrent cases
94 pan-negative* lung adenocarcinomas

| Sample | Age | Sex | Stage | Smoking status | AD subtype |
|---|---|---|---|---|---|
| Case-1 | 73 | female | Ia | never | Invasive mucinous |
| Case-2 | 72 | female | Ia | never | Invasive mucinous |
| Case-3 | 66 | female | Ia | never | Invasive mucinous |
| Case-4 | 31 | female | Ia | never | Invasive mucinous |

*EGFR, KRAS, BRAF, HER2, ALK, ROS, RET negative

SUPPLEMENTARY TABLE 3

Screening of NGR-CD74 fusion transcript in pan-negative NSCLCs and other cancer types

|  | Fused | No fusion | Total |
|---|---|---|---|
| Histology | | | |
| AIS | 0 | 7 | 7 |
| SQC | 0 | 43 | 43 |
| AS | 0 | 5 | 5 |
| LCC | 0 | 7 | 7 |
| LCNEC | 0 | 5 | 5 |
| SCLC | 0 | 2 | 2 |
| Carcinoid | 0 | 1 | 1 |
| Cancer type | | | |
| Breast cancer | 0 | 4 | 4 |
| Colorectal cancer | 0 | 8 | 8 |
| Esophageal cancer | 0 | 5 | 5 |
| Gastric cancer | 0 | 4 | 4 |

SUPPLEMENTARY TABLE 4

Expression of ERBB receptors

| | EGFR | | | | ERBB2 |
|---|---|---|---|---|---|
| ref_gene_id | NM_005228 | NM_201282 | NM_201283 | NM_201284 | NM_001005862 |
| S00545 | 3.33 | 0.00 | 0.00 | 0.00 | 0.67 |
| S00557 | 6.09 | 0.00 | 0.17 | 0.10 | 2.18 |
| S00585 | 10.32 | 0.00 | 0.17 | 0.07 | 0.94 |
| S00611 | 1.86 | 0.00 | 0.00 | 0.00 | 1.06 |
| S00664 | 4.31 | 0.00 | 0.08 | 0.07 | 0.28 |
| S00684 | 3.23 | 0.00 | 0.00 | 0.00 | 1.16 |
| S00686 | 6.63 | 0.00 | 0.08 | 0.00 | 2.00 |
| S00687 | 4.80 | 0.00 | 0.00 | 0.00 | 1.69 |
| S00688 | 10.15 | 0.00 | 0.15 | 0.11 | 0.62 |
| S00726 | 8.84 | 0.00 | 0.04 | 0.00 | 1.80 |
| S00737 | 5.19 | 0.00 | 0.00 | 0.00 | 0.49 |
| S00738 | 8.50 | 0.00 | 0.00 | 0.01 | 0.45 |
| S00747 | 4.42 | 0.00 | 0.04 | 0.00 | 2.89 |
| S00751 | 5.53 | 0.00 | 0.00 | 0.00 | 0.28 |
| S00752 | 4.98 | 0.00 | 0.00 | 0.01 | 3.01 |
| S00754 | 11.11 | 0.00 | 0.18 | 0.02 | 0.90 |
| S00755 | 16.10 | 0.00 | 0.04 | 0.05 | 1.05 |
| S01052_Index-case | 1.89 | 0.00 | 0.04 | 0.00 | 0.54 |
| S01156 | 4.22 | 0.00 | 0.07 | 0.00 | 0.57 |
| S01194 | 2.39 | 0.00 | 0.12 | 0.00 | 1.34 |
| S01272 | 23.62 | 0.00 | 0.11 | 0.02 | 2.83 |
| S01276 | 4.36 | 0.00 | 0.00 | 0.02 | 0.76 |
| S01337 | 4.75 | 0.00 | 0.00 | 0.00 | 0.33 |
| S01465 | 13.88 | 0.00 | 0.07 | 0.02 | 0.99 |
| Average (FPKM) | 7.1 | | | | |

| | ERBB2 | ERBB3 | ERBB4 | |
|---|---|---|---|---|
| ref_gene_id | NM_004448 | NM_001982 | NM_001042599 | NM_005235 |
| S00545 | 37.40 | 15.40 | 0.00 | 0.00 |
| S00557 | 48.55 | 72.23 | 0.23 | 0.00 |
| S00585 | 27.49 | 26.39 | 0.03 | 0.00 |
| S00611 | 21.46 | 6.59 | 0.03 | 0.00 |
| S00664 | 17.40 | 15.53 | 0.12 | 0.00 |
| S00684 | 86.02 | 26.63 | 0.10 | 0.00 |
| S00686 | 26.64 | 22.22 | 0.48 | 0.00 |
| S00687 | 93.38 | 78.43 | 0.60 | 0.00 |
| S00688 | 19.95 | 16.43 | 0.13 | 0.00 |
| S00726 | 16.65 | 34.47 | 0.00 | 0.00 |
| S00737 | 20.29 | 14.28 | 0.51 | 0.00 |
| S00738 | 30.59 | 41.59 | 0.52 | 0.00 |
| S00747 | 61.83 | 22.21 | 0.13 | 0.00 |
| S00751 | 41.09 | 47.88 | 0.05 | 0.00 |
| S00752 | 59.04 | 28.30 | 0.46 | 0.00 |
| S00754 | 27.54 | 22.29 | 0.59 | 0.00 |
| S00755 | 33.40 | 54.94 | 0.00 | 0.18 |
| S01052_Index-case | 22.90 | 22.81 | 0.20 | 0.00 |
| S01156 | 41.45 | 35.50 | 0.00 | 0.00 |
| S01194 | 4.08 | 3.42 | 0.09 | 0.00 |
| S01272 | 50.43 | 32.32 | 0.05 | 0.00 |
| S01276 | 29.66 | 33.12 | 0.04 | 0.00 |
| S01337 | 92.87 | 47.61 | 0.00 | 0.12 |
| S01465 | 53.95 | 33.39 | 0.42 | 0.00 |
| Average (FPKM) | 40.2 | 31.4 | 0.2 | |

REFERENCES IN EXAMPLE 1

1. Pao, W. & Hutchinson, K. E. *Nat. Med.* 18, 349-51 (2012)
2. Soda, M. et al. *Nature* 448, 561-6 (2007)
3. Takeuchi, K. et al. *Nat. Med.* 3-6 (2012)
4. Kohno, T. et al. *Nat. Med.* 18, 375-7 (2012)
5. Lipson, D. et al. *Nat. Med.* 13-15 (2012)
6. Chao, B. H. et al. *J Clin. Oncol.* 13-16 (2012)
7. Ohashi, K. et al. *J Clin. Oncol.* 31, 1070-80 (2013)
7. Camidge, D. R. et al. *Lancet Oncol.* 2045, 11-15 (2012)
8. Bergethon, K. et al. *J Clin. Oncol.* 30, 863-70 (2012)
9. Shaw A T, et al., New Engl J Med, 368:2385-94 (2013).
10. Maeda, Y. et al. *J. Clin. Invest.* 122, (2012)
11. Hynes, N. E. & Lane, H. A. *Nat. Rev. Cancer* 5, 341-54 (2005)
12. Mei, L. & Xiong, W. *Nat. Rev. Neurosci.* 9, (2008)
13. Talmage, D. A. *Novartis Found. Symp.* 1-11 (2008)
14. Falls, D. *Exp. Cell Res.* 284, 14-30 (2003)
15. Wallasch, C. et al. *EMBO J* 14, 4267-75 (1995)
16. Yarden, Y. & Pines, G. *Nat. Rev. Cancer* 12, 553-63 (2012)
17. Wallasch, C. et al. *EMBO J* 14, 4267-75 (1995)
18. Peifer, M. et al. *Nat. Genet.* 44, 1104-1110 (2012)
19. Wilbertz T, et al. Modern Pathol, 24:944-53 (2011).

EXAMPLE 2: IDENTIFICATION OF THE MTSS1-NRG1 FUSION TRANSCRIPT IN SCLC

Materials and Methods
1. Sample Preparation, RNA and DNA Extraction, and Illumina Sequencing Genome and transcriptome studies were performed on resected fresh-frozen tumors from SCLC patients.

RNA-seq was performed on RNA that was extracted from tumor tissues following the protocols as described in Example 1. cDNA libraries were generated to perform RNA-seq sequencing on an Illumina platform (see Example 1).

Whole genome sequencing was performed on genomic DNA that was extracted from tissue sections of the tumor and of the matched normal tumor-free lung. The tissue sections were lysed for 24 h and the DNA was extracted following the instructions of the Puregene Extraction Kit (Qiagen). The DNA was eluted in 1×TE buffer and diluted to a working concentration of 100 ng/μl. Whole genome analysis was performed on the tumor and normal DNA by paired-end sequencing on the Illumina HiSeq™ 2000 platform. A read length of 2×100 bp was used and the sequenced with mean coverage of 30×.

2. RNAseq Analysis

Paired-end RNAseq reads were analyzed following the computational analysis pipeline described in Example 1. The output of this pipeline provides information on putative fusion transcripts.

3. Validation of Putative Fusion Transcripts

The validation of chimeric transcripts was performed as follows: the cDNA of the respective primary tumor was generated and the nucleotide sequence covering the breakpoint of the fusion transcript MTSS1-NRG1 was validated by Sanger sequencing.

The following primer pairs were designed to confirm the nucleotide fusion of MTSS1-NRG1.

```
F-primer:    5'-CGCTCGGAGGCCTCTTCCAGA-3'

R-primer:    5'-TGCGAAGTTCTGACTTCCCTGGC-3'
```

4. Identification of Genomic Rearrangements from Whole Genome Sequencing Data

Whole genome sequencing data of tumor and matching normal tissue was used to identify and reconstruct genomic rearrangements. The computational pipeline underlying this analysis is described in reference 18 (see Example 1). In brief, this method screened for unmapped or delocalized read pairs, and the identified reads were re-aligned to the human reference genome (hg19). The results were compared to the sequencing data of the normal tissue of the patient, to thus confirm that the identified translocation is a somatic event.

Results
Detection of the MTSS1-NRG1 Translocation:

In order to comprehensively analyse the genome and transcriptome of small cell lung cancer patients we performed RNAseq on a cohort of over 40 fresh-frozen SCLC tumor tissues. The aim was to identify potential fusion transcripts that may play a decisive role in this lung cancer subtype. The transcriptome analysis on fresh-frozen tumor tissues of small cell lunger patients led to the identification of the MTSS1-NRG1 translocation (sample S02241). The nucleotide sequence hints at an intrachromosomal rearrangement of the genes MTSS1 and NRG1, both located on chromosome 8. The subsequent transcript describes the fusion of exon 3 of MTSS1 (NM_014751.4) with exon 2 of NRG1 (NM_013958.3, variant HRG-beta 3). The nucleotide sequence of this fusion event was confirmed by Sanger sequencing (FIG. 3).

In order to confirm that the identified fusion transcript is a result of a genomic rearrangement, we decided to perform whole genome sequencing on this sample. In agreement with the RNA-seq data, we were able to detect the MTSS1-NRG1 fusion event on a genomic level (FIG. 10).

As already implicated by the transcriptome study, genome sequencing data identified breakpoints in the intron regions between exon 3 and 4 of MTSS1 and exon 1 and 2 of NRG1. Consequently, the coding strands of both genes are found to be fused in-frame, leading to the fusion transcript that was identified by RNA-seq. This data was compared to the genome sequencing data of the matched normal tissue; no alterations or translocation were detected in the gene region of the tumor-free sample. This analysis therefore confirms that the detected MTSS1-NRG1 fusion is a genomic and somatic event in SCLC.

Figure 4:
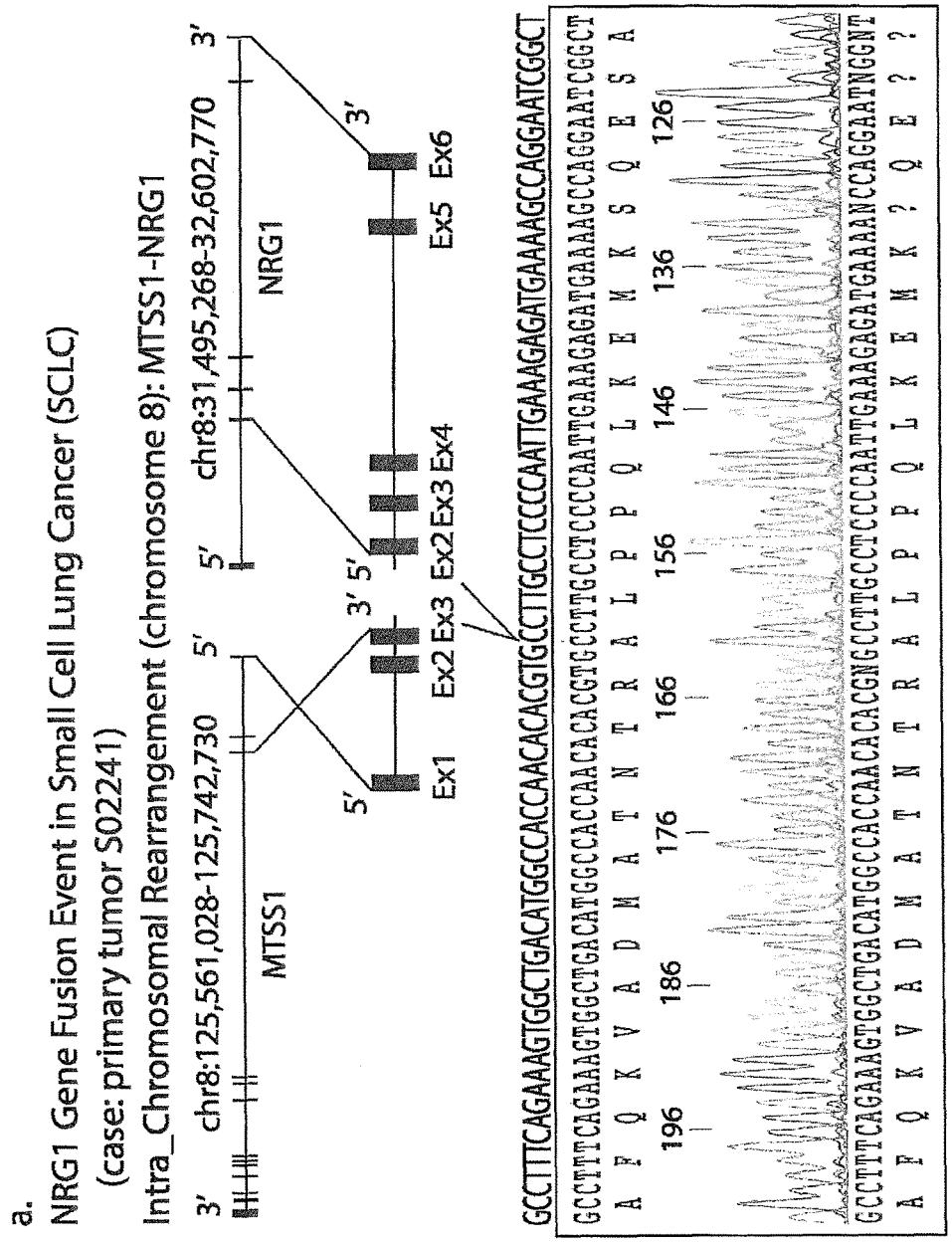
Figure 4:
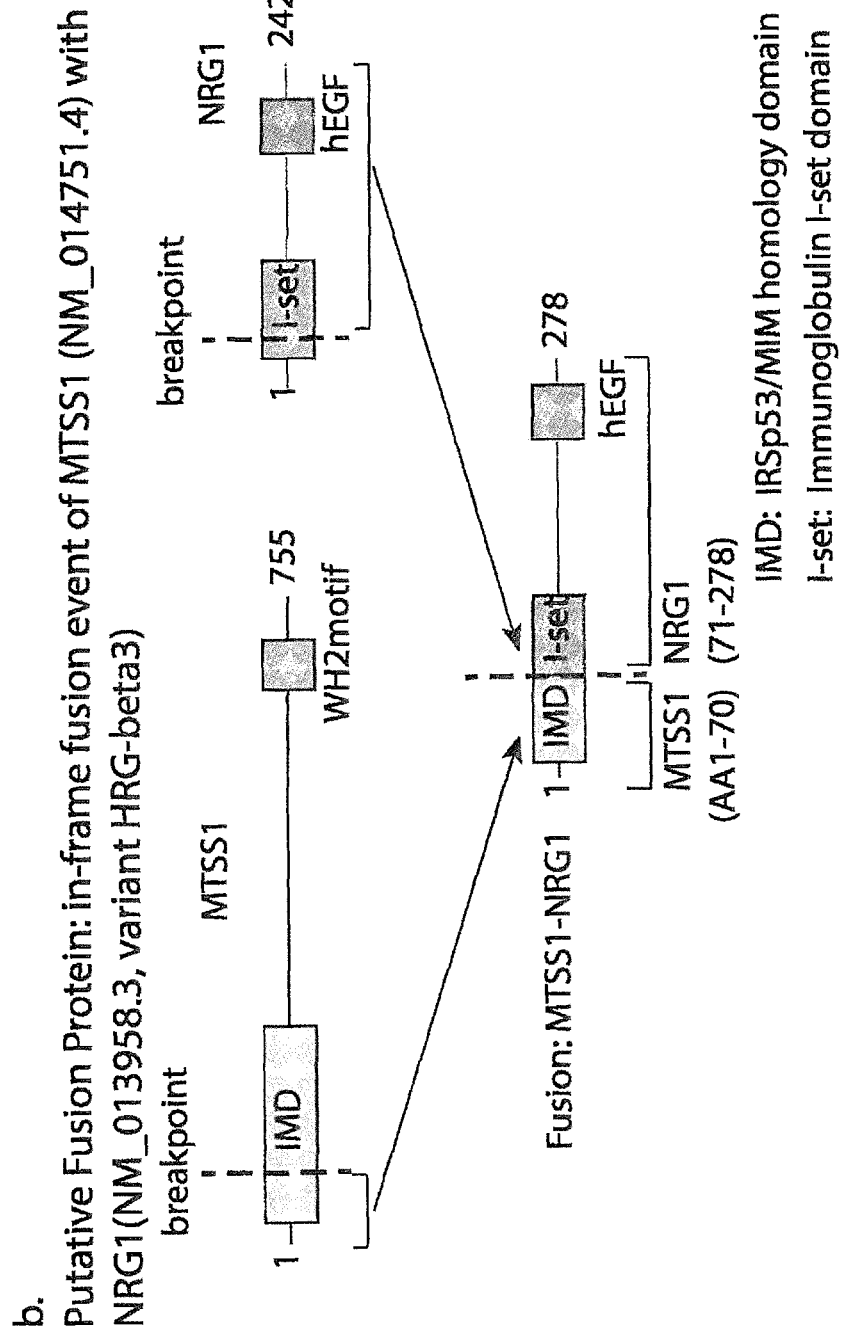

The nucleotide fusion consequently suggests for an in-frame translocation of MTSS1 with NRG1 encoding for a MTSS1-NRG1 fusion protein with a length of 278 amino acids. The translated protein would hold at its aminoterminal end the first 70 amino acids of the MTSS1 protein, thus covering parts of the IRSp53/MIM homology domain (IMD). This part of the MTSS1 protein sequence is then fused to the protein sequence of NRG1 retaining the Immunoglobulin I-set (I-set) and the human epithelial growth factor (hEGF) domains (FIG. 4). As described in Example 1, NRG1 is a known ligand for receptors of the EGFR family. The herein identified MTSS1-NRG1 fusion protein retains its EGF-like domain and could thus still maintain the interaction with the receptors of the EGFR family.

In order to further assess the relevance of NRG1 in SCLC, the expression of the NRG1 gene was analyzed in the transcriptome data of all SCLC samples analyzed, revealing in the majority of the samples a moderate expression level of over 1 FPKM. The sample holding the MTSS1-NRG1 fusion transcript (S02241) was quantified with a FPKM value of 6.9, thus revealing the second highest expression of NRG1 in all SCLC samples analyzed (FIG. 5).

In sum, fresh-frozen tumor biopsies of small cell lung cancer (SCLC) patients were subjected to transcriptome sequencing with the aim of identifying chimeric transcripts and fusion genes. The analysis resulted in the identification of the MTSS1-NRG1 fusion transcript comprising the nucleotide sequences of MTSS1 and NRG1, and resulting in the in-frame translation of a potential MTSS1-NRG1 fusion protein. In reference to Example 1, this finding implicates recurrence of NRG1 fusion proteins in different lung cancer histotypes.

EXAMPLE 3: THE CD74-NRG1 FUSION TRIGGERS ITS ONCOGENIC SIGNALING CASCADE VIA THE PHOSPHOINOSITIDE-3-KINASE PATHWAY

Methods:

H1568 was obtained from the American Type Culture Collection (ATCC) and maintained in RPMI-1640 medium (Life Technologies) supplemented with 10% fetal cal serum (FCS; Gibco) and 1% penicillin-streptomycin (PS; Gibco). The cells were cultivated in a humidified incubator at 37° C., 5% $CO_2$. Wild-type status of KRAS and ERBB1-3 was confirmed by Sanger sequencing. The cells were seeded at 50% confluency and serum-starved (0% FCS) for 24 hours. Afatinib treatment was conducted at according timepoints. For the treatment Afatinib (stock 10 mM) was diluted in RPMI-1640 medium without FCS and/or PS.

Generation of empty vector control, CD74-NRG1, CD74-NRG1_del cells was done via retroviral transduction following puromycin selection (3 µg/ml).

Western Blot analysis was done following standard procedures. The antibodies were diluted in TBST supplied with 0.1% $NaN_3$ and incubated overnight. The following primary antibodies were used for the experiment:

p-AKT Ser473 (Cell Signaling Technology; Catalog No. #9271) and Acting horseradish peroxidase (HRP) (Santa Cruz Biotechnology; Catalog No. #sc47778).

For analysis of protein levels, anti-rabbit-HRP secondary antibodies (Millipore) were used following enhanced chemiluminescence (ECL) reagent (GE-Healthcare) detection.

Results:

The CD74-NRG1 fusion triggers its oncogenic signaling cascade via the ERBB3 receptor. Due to its strongly impaired kinase-activity ERBB3 needs an interaction partner forming heterodimers with different ERBB receptors (1, 2 or 4). In our experiments (and in the index patient) ERRB2 is most probably the heterodimerization partner of ERBB3 upon CD74-NRG1 binding. Compared to transduced empty vector control cells or cells with a truncated version of CD74-NRG1 (CD74-NRG1_del; lacking the EGF-like domain of NRG1) CD74-NRG1 transduced H1568 cells show increased phosphoinositide-3-kinase pathway activation. As there are few specific drugs against ERBB3 available, Afatanib as a potent and specific drug against EGFR and ERBB2 was a promising compound for treating the H1568 cells. Indeed doses of only 100 nM Afatinib for 12 h and/or 24 h phosphorylation of AKT which is one of the key proteins in phosphoinositide-3-kinase pathway which is important for cellular growth and survival. This is a key finding for the CD74-NRG1 suffering patients, as there is up to now no treatment option for these patients available.

The present invention refers to the following nucleotide and amino acid sequences:

The sequences provided herein are available in the NCBI database and can be retrieved from www.ncbi.nlm.nih.gov/sites/entrez?db=gene; Theses sequences also relate to annotated and modified sequences. The present invention also provides techniques and methods wherein homologous sequences, variants and fragments of the concise sequences provided herein are used. Preferably, such "variants" are genetic variants.

```
Amino acid sequence of Homo sapiens CD74-NRG1 fusion protein
SEQ ID No. 1:
MHRRRSRSCREDQKPVMDDQRDLISNNEQLPMLGRRPGAPESKCSRGALYTGFSILVTLLLAGQATTAYFLYQ

QQGRLDKLTVTSQNLQLENLRMKLPKPPKPVSKMRMATPLLMQALPMGALPQGPMQNATKYGNMTEDHVMHLL

QNADPLKVYPPLKGSFPENLRHLKNTMETIDWKVFESWMHHWLLFEMSRHSLEQKPTDAPPKATSTSTTGTSH

LVKCAEKEKTFCVNGGECFMVKDLSNPSRYLCKCPNEFTGDRCQNYVMASFYSTSTPFLSLPE

Nucleotide sequence (cDNA) encoding Homo sapiens CD74-NRG1 fusion protein
SEQ ID No. 2:
ATGCACAGGAGGAGAAGCAGGAGCTGTCGGGAAGATCAGAAGCCAGTCATGGATGACCAGCGCGACCTTATCT

CCAACAATGAGCAACTGCCCATGCTGGGCCGGCGCCCTGGGGCCCCGGAGAGCAAGTGCAGCCGCGGAGCCCT

GTACACAGGCTTTTCCATCCTGGTGACTCTGCTCCTCGCTGGCCAGGCCACCACCGCCTACTTCCTGTACCAG

CAGCAGGGCCGGCTGGACAAACTGACAGTCACCTCCCAGAACCTGCAGCTGGAGAACCTGCGCATGAAGCTTC

CCAAGCCTCCCAAGCCTGTGAGCAAGATGCGCATGGCCACCCCGCTGCTGATGCAGGCGCTGCCCATGGGAGC

CCTGCCCCAGGGGCCCATGCAGAATGCCACCAAGTATGGCAACATGACAGAGGACCATGTGATGCACCTGCTC

CAGAATGCTGACCCCCTGAAGGTGTACCCGCCACTGAAGGGGAGCTTCCCGGAGAACCTGAGACACCTTAAGA

ACACCATGGAGACCATAGACTGGAAGGTCTTTGAGAGCTGGATGCACCATTGGCTCCTGTTTGAAATGAGCAG

GCACTCCTTGGAGCAAAAGCCCACTGACGCTCCACCGAAAGCTACATCTACATCCACCACTGGGACAAGCCAT

CTTGTAAAATGTGCGGAGAAGGAGAAAACTTTCTGTGTGAATGGAGGGGAGTGCTTCATGGTGAAAGACCTTT

CAAACCCCTCGAGATACTTGTGCAAGTGCCCAAATGAGTTTACTGGTGATCGCTGCCAAAACTACGTAATGGC

CAGCTTCTACAGTACGTCCACTCCCTTTCTGTCTCTGCCTGAATAG
```

-continued

Nucleotide sequence (mRNA) encoding Homo sapiens CD74-NRG1 fusion protein
SEQ ID No. 3:
AUGCACAGGAGGAGAAGCAGGAGCUGUCGGGAAGAUCAGAAGCCAGUCAUGGAUGACCAGCGCGACCUUAUCU

CCAACAAUGAGCAACUGCCCAUGCUGGGCCGGCGCCCUGGGGCCCCGGAGAGCAAGUGCAGCCGCGGAGCCCU

GUACACAGGCUUUUCCAUCCUGGUGACUCUGCUCCUCGCUGGCCAGGCCACCACCGCCUACUUCCUGUACCAG

CAGCAGGGCCGGCUGGACAAACUGACAGUCACCUCCCAGAACCUGCAGCUGGAGAACCUGCGCAUGAAGCUUC

CCAAGCCUCCCAAGCCUGUGAGCAAGAUGCGCAUGGCCACCCCGCUGCUGAUGCAGGCGCUGCCCAUGGGAGC

CCUGCCCCAGGGGCCCAUGCAGAAUGCCACCAAGUAUGGCAACAUGACAGAGGACCAUGUGAUGCACCUGCUC

CAGAAUGCUGACCCCCUGAAGGUGUACCCGCCACUGAAGGGGAGCUUCCCGGAGAACCUGAGACACCUUAAGA

ACACCAUGGAGACCAUAGACUGGAAGGUCUUUGAGAGCUGGAUGCACCAUUGGCUCCUGUUUGAAAUGAGCAG

GCACUCCUUGGAGCAAAAGCCCACUGACGCUCCACCGAAAGCUACAUCUACAUCCACCACUGGGACAAGCCAU

CUUGUAAAAUGUGCGGAGAAGGAGAAAACUUUCUGUGUGAAUGGAGGGGAGUGCUUCAUGGUGAAAGACCUUU

CAAACCCCUCGAGAUACUUGUGCAAGUGCCCAAAUGAGUUUACUGGUGAUCGCUGCCAAAACUACGUAAUGGC

CAGCUUCUACAGUACGUCCACUCCCUUUCUGUCUCUGCCUGAAUAG

Amino acid sequence of Homo sapiens NRG1
SEQ ID No. 4:
MSERKEGRGKGKGKKKERGSGKKPESAAGSQSPALPPRLKEMKSQESAAGSKLVLRCETSSEYSSLRFKWFKN

GNELNRKNKPQNIKIQKKPGKSELRINKASLADSGEYMCKVISKLGNDSASANITIVESNEHTGMPASTEGAY

VSSESPIRISVSTEGANTSSSTSTSTTGTSHLVKCAEKEKTFCVNGGECFMVKDLSNPSRYLCKCPNEFTGDR

CQNYVMASFYKHLGIEFMEAEELYQKRVLTITGICIALLVVGIMCVVAYCKTKKQRKKLHDRLRQSLRSERNN

MMNIANGPHHPNPPPENVQLVNQYVSKNVISSEHIVEREAETSFSTSHYTSTAHHSTTVTQTPSHSWSNGHTE

SILSESHSVIVMSSVENSRHSSPTGGPRGRLNGTGGPRECNSFLRHARETPDSYRDSPHSERYVSAMTTPARM

SPVDFHTPSSPKSPPSEMSPPVSSMTVSMPSMAVSPFMEEERPLLLVTPPRLREKKFDHHPQQFSSFHHNPAH

DSNSLPASPLRIVEDEEYETTQEYEPAQEPVKKLANSRRAKRTKPNGHIANRLEVDSNTSSQSSNSESETEDE

RVGEDTPFLGIQNPLAASLEATPAFRLADSRTNPAGRFSTQEEIQARLSSVIANQDPIAV

Amino acid sequence of Homo sapiens CD74
SEQ ID No. 5:
MHRRRSRSCREDQKPVMDDQRDLISNNEQLPMLGRRPGAPESKCSRGALYTGFSILVTLLLAGQATTAYFLYQ

QQGRLDKLTVTSQNLQLENLRMKLPKPPKPVSKMRMATPLLMQALPMGALPQGPMQNATKYGNMTEDHVMHLL

QNADPLKVYPPLKGSFPENLRHLKNTMETIDWKVFESWMHHWLLFEMSRHSLEQKPTDAPPKESLELEDPSSG

LGVTKQDLGPVPM

Amino acid sequence of Homo sapiens NRG1
SEQ ID No. 6:
ATSTSTTGTSHLVKCAEKEKTFCVNGGECFMVKDLSNPSRYLCKCPNEFTGDRCQNYVMASFYSTSTPFLSLP

E

Amino acid sequence of Homo sapiens CD74
SEQ ID No. 7:
MHRRRSRSCREDQKPVMDDQRDLISNNEQLPMLGRRPGAPESKCSRGALYTGFSILVTLLLAGQATTAYFLYQ

QQGRLDKLTVTSQNLQLENLRMKLPKPPKPVSKMRMATPLLMQALPMGALPQGPMQNATKYGNMTEDHVMHLL

QNADPLKVYPPLKGSFPENLRHLKNTMETIDWKVFESWMHHWLLFEMSRHSLEQKPTDAPPK

Nucleotide sequence encoding Homo sapiens NRG1
SEQ ID No. 8:
CUACAUCUACAUCCACCACUGGGACAAGCCAUCUUGUAAAAUGUGCGGAGAAGGAGAAAACUUUCUGUGUGAA

UGGAGGGGAGUGCUUCAUGGUGAAAGACCUUUCAAACCCCUCGAGAUACUUGUGCAAGUGCCCAAAUGAGUUU

ACUGGUGAUCGCUGCCAAAACUACGUAAUGGCCAGCUUCUACAGUACGUCCACUCCCUUUCUGUCUCUGCCUG

AAUAG

-continued

Nucleotide sequence encoding *Homo sapiens* CD74
SEQ ID No. 9:
AUGCACAGGAGGAGAAGCAGGAGCUGUCGGGAAGAUCAGAAGCCAGUCAUGGAUGACCAGCGCGACCUUAUCU

CCAACAAUGAGCAACUGCCCAUGCUGGGCCGGCGCCCUGGGGCCCCGGAGAGCAAGUGCAGCCGCGGAGCCCU

GUACACAGGCUUUUCCAUCCUGGUGACUCUGCUCCUCGCUGGCCAGGCCACCACCGCCUACUUCCUGUACCAG

CAGCAGGGCCGGCUGGACAAACUGACAGUCACCUCCCAGAACCUGCAGCUGGAGAACCUGCGCAUGAAGCUUC

CCAAGCCUCCCAAGCCUGUGAGCAAGAUGCGCAUGGCCACCCCGCUGCUGAUGCAGGCGCUGCCCAUGGGAGC

CCUGCCCCAGGGGCCCAUGCAGAAUGCCACCAAGUAUGGCAACAUGACAGAGGACCAUGUGAUGCACCUGCUC

CAGAAUGCUGACCCCCUGAAGGUGUACCCGCCACUGAAGGGGAGCUUCCCGGAGAACCUGAGACACCUUAAGA

ACACCAUGGAGACCAUAGACUGGAAGGUCUUUGAGAGCUGGAUGCACCAUUGGCUCCUGUUUGAAAUGAGCAG

GCACUCCUUGGAGCAAAAGCCCACUGACGCUCCACCGAAAG

Amino acid sequence of *Homo sapiens* MTSS1-NRG1 fusion protein
SEQ ID No. 10:
MEAVIEKECSALGGLFQTIISDMKGSYPVWEDFINKAGKLQSQLRTTVVAAAAFLDAFQKVADMATNTRALPP

QLKEMKSQESAAGSKLVLRCETSSEYSSLRFKWFKNGNELNRKNKPQNIKIQKKPGKSELRINKASLADSGEY

MCKVISKLGNDSASANITIVESNEIITGMPASTEGAYVSSESPIRISVSTEGANTSSSTSTSTTGTSHLVKCA

EKEKTFCVNGGECFMVKDLSNPSRYLCKCPNEFTGDRCQNYVMASFYSTSTPFLSLPE

Nucleotide sequence (cDNA) encoding *Homo sapiens* MTSS1-NRG1 fusion protein
SEQ ID No. 11:
ATGGAGGCTGTGATTGAGAAGGAATGCAGCGCGCTCGGAGGCCTCTTCCAGACCATCATCAGCGACATGAAGG

GGAGCTATCCAGTTTGGGAAGATTTCATAAACAAAGCAGGAAAGCTGCAGTCCCAGCTTCGGACAACAGTAGT

AGCAGCAGCTGCCTTCTTGGACGCCTTTCAGAAAGTGGCTGACATGGCCACCAACACACGTGCCTTGCCTCCC

CAATTGAAAGAGATGAAAAGCCAGGAATCGGCTGCAGGTTCCAAACTAGTCCTTCGGTGTGAAACCAGTTCTG

AATACTCCTCTCTCAGATTCAAGTGGTTCAAGAATGGGAATGAATTGAATCGAAAAAACAAACCACAAAATAT

CAAGATACAAAAAAAGCCAGGGAAGTCAGAACTTCGCATTAACAAAGCATCACTGGCTGATTCTGGAGAGTAT

ATGTGCAAAGTGATCAGCAAATTAGGAAATGACAGTGCCTCTGCCAATATCACCATCGTGGAATCAAACGAGA

TCATCACTGGTATGCCAGCCTCAACTGAAGGAGCATATGTGTCTTCAGAGTCTCCCATTAGAATATCAGTATC

CACAGAAGGAGCAAATACTTCTTCATCTACATCTACATCCACCACTGGGACAAGCCATCTTGTAAAATGTGCG

GAGAAGGAGAAAACTTTCTGTGTGAATGGAGGGGAGTGCTTCATGGTGAAAGACCTTTCAAACCCCTCGAGAT

ACTTGTGCAAGTGCCCAAATGAGTTTACTGGTGATCGCTGCCAAAACTACGTAATGGCCAGCTTCTACAGTAC

GTCCACTCCCTTTCTGTCTCTGCCTGAATAG

Nucleotide sequence (mRNA) encoding *Homo sapiens* MTSS1-NRG1 fusion protein
SEQ ID No. 12:
AUGGAGGCUGUGAUUGAGAAGGAAUGCAGCGCGCUCGGAGGCCUCUUCCAGACCAUCAUCAGCGACAUGAAGG

GGAGCUAUCCAGUUUGGGAAGAUUUCAUAAACAAAGCAGGAAAGCUGCAGUCCCAGCUUCGGACAACAGUAGU

AGCAGCAGCUGCCUUCUUGGACGCCUUUCAGAAAGUGGCUGACAUGGCCACCAACACACGUGCCUUGCCUCCC

CAAUUGAAAGAGAUGAAAAGCCAGGAAUCGGCUGCAGGUUCCAAACUAGUCCUUCGGUGUGAAACCAGUUCUG

AAUACUCCUCUCUCAGAUUCAAGUGGUUCAAGAAUGGGAAUGAAUUGAAUCGAAAAAACAAACCACAAAAUAU

CAAGAUACAAAAAAAGCCAGGGAAGUCAGAACUUCGCAUUAACAAAGCAUCACUGGCUGAUUCUGGAGAGUAU

AUGUGCAAAGUGAUCAGCAAAUUAGGAAAUGACAGUGCCUCUGCCAAUAUCACCAUCGUGGAAUCAAACGAGA

UCAUCACUGGUAUGCCAGCCUCAACUGAAGGAGCAUAUGUGUCUUCAGAGUCUCCCAUUAGAAUAUCAGUAUC

CACAGAAGGAGCAAAUACUUCUUCAUCUACAUCUACAUCCACCACUGGGACAAGCCAUCUUGUAAAAUGUGCG

GAGAAGGAGAAAACUUUCUGUGUGAAUGGAGGGGAGUGCUUCAUGGUGAAAGACCUUUCAAACCCCUCGAGAU

-continued

ACUUGUGCAAGUGCCCAAAUGAGUUUACUGGUGAUCGCUGCCAAAACUACGUAAUGGCCAGCUUCUACAGUAC

GUCCACUCCCUUUCUGUCUCUGCCUGAAUAG

Amino acid sequence of *Homo sapiens* NRG1
SEQ ID No. 13:
ALPPQLKEMKSQESAAGSKLVLRCETSSEYSSLRFKWFKNGNELNRKNKPQNIKIQKKPGKSELRINKASLAD

SGEYMCKVISKLGNDSASANITIVESNEIITGMPASTEGAYVSSESPIRISVSTEGANTSSSTSTSTTGTSHL

VKCAEKEKTFCVNGGECFMVKDLSNPSRYLCKCPNEFTGDRCQNYVMASFYSTSTPFLSLPE

Amino acid sequence of *Homo sapiens* MTSS1
SEQ ID No. 14:
MEAVIEKECSALGGLFQTIISDMKGSYPVWEDFINKAGKLQSQLRTTVVAAAAFLDAFQKVADMATNTR Nucleotide sequence encoding *Homo sapiens* NRG1
SEQ ID No. 15:
CCUUGCCUCCCCAAUUGAAAGAGAUGAAAAGCCAGGAAUCGGCUGCAGGUUCCAAACUAGUCCUUCGGUGUGA

AACCAGUUCUGAAUACUCCUCUCUCAGAUUCAAGUGGUUCAAGAAUGGGAAUGAAUUGAAUCGAAAAACAAA

CCACAAAAUAUCAAGAUACAAAAAAAGCCAGGGAAGUCAGAACUUCGCAUUAACAAAGCAUCACUGGCUGAUU

CUGGAGAGUAUAUGUGCAAAGUGAUCAGCAAAUUAGGAAAUGACAGUGCCUCUGCCAAUAUCACCAUCGUGGA

AUCAAACGAGAUCAUCACUGGUAUGCCAGCCUCAACUGAAGGAGCAUAUGUGUCUUCAGAGUCUCCCAUUAGA

AUAUCAGUAUCCACAGAAGGAGCAAAUACUUCUUCAUCUACAUCUACAUCCACCACUGGGACAAGCCAUCUUG

UAAAAUGUGCGGAGAAGGAGAAAACUUUCUGUGUGAAUGGAGGGGAGUGCUUCAUGGUGAAAGACCUUUCAAA

CCCCUCGAGAUACUUGUGCAAGUGCCCAAAUGAGUUUACUGGUGAUCGCUGCCAAAACUACGUAAUGGCCAGC

UUCUACAGUACGUCCACUCCCUUUCUGUCUCUGCCUGAAUAG

Nucleotide sequence encoding *Homo sapiens* MTSS1
SEQ ID No. 16:
AUGGAGGCUGUGAUUGAGAAGGAAUGCAGCGCGCUCGGAGGCCUCUUCCAGACCAUCAUCAGCGACAUGAAGG

GGAGCUAUCCAGUUUGGGAAGAUUUCAUAAACAAAGCAGGAAAGCUGCAGUCCCAGCUUCGGACAACAGUAGU

AGCAGCAGCUGCCUUCUUGGACGCCUUUCAGAAAGUGGCUGACAUGGCCACCAACACACGUG

Amino acid sequence of *Homo sapiens* MTSS1
SEQ ID No. 17:
MEAVIEKECSALGGLFQTIISDMKGSYPVWEDFINKAGKLQSQLRTTVVAAAAFLDAFQKVADMATNTRGGTR

EIGSALTRMCMRHRSIEAKLRQFSSALIDCLINPLQEQMEEWKKVANQLDKDHAKEYKKARQEIKKKSSDTLK

LQKKAKKGRGDIQPQLDSALQDVNDKYLLLEETEKQAVRKALIEERGRECTFISMLRPVIEEEISMLGEITHL

QTISEDLKSLTMDPHKLPSSSEQVILDLKGSDYSWSYQTPPSSPSTTMSRKSSVCSSLNSVNSSDSRSSGSHS

HSPSSHYRYRSSNLAQQAPVRLSSVSSHDSGFISQDAFQSKSPSPMPPEAPNQLSNGFSHYSLSSESHVGPTG

AGLFPHCLPASRLLPRVTSVHLPDYAHYYTIGPGMFPSSQIPSWKDWAKPGPYDQPLVNTLQRRKEKREPDPN

GGGPTTASGPPAAAEEAQRPRSMTVSAATRPGEEMEACEELALALSRGLQLDTQRSSRDSLQCSSGYSTQTTT

PCCSEDTIPSQVSDYDYFSVSGDQEADQQEFDKSSTIPRNSDISQSYRRMFQAKRPASTAGLPTTLGPAMVTP

GVATIRRTPSTKPSVRRGTIGAGPIPIKTPVIPVKTPTVPDLPGVLPAPPDGPEERGEHSPESPSVGEGPQGV

TSMPSSMWSGQASVNPPLPGPKPSIPEEHRQAIPESEAEDQEREPPSATVSPGQIPESDPADLSPRDTPQGED

MLNAIRRGVKLKKTTTNDRSAPRFS

Nucleotide sequence encoding *Homo sapiens* MTSS1
SEQ ID No. 18:
AUGGAGGCUGUGAUUGAGAAGGAAUGCAGCGCGCUCGGAGGCCUCUUCCAGACCAUCAUCAGCGACAUGAAGG

GGAGCUAUCCAGUUUGGGAAGAUUUCAUAAACAAAGCAGGAAAGCUGCAGUCCCAGCUUCGGACAACAGUAGU

-continued

```
AGCAGCAGCUGCCUUCUUGGACGCCUUUCAGAAAGUGGCUGACAUGGCCACCAACACACGUGGUGGGACCAGG

GAGAUUGGAUCUGCUCUCACCAGGAUGUGCAUGAGGCACAGAAGCAUUGAAGCCAAGCUGAGGCAGUUUUCGA

GCGCUUUAAUUGAUUGUCUGAUAAACCCACUUCAAGAACAGAUGGAAGAAUGGAAGAAAGUGGCCAACCAGCU

GGAUAAAGACCACGCAAAAGAAUAUAAGAAAGCCCGCCAAGAGAUAAAAAAGAAGUCCUCGGAUACGCUGAAA

CUGCAGAAGAAAGCAAAAAAGGGAGAGGUGAUAUCCAGCCUCAGUUGGACAGUGCUCUCCAAGAUGUCAAUG

AUAAGUAUCUCUUAUUGGAAGAAACAGAAAAGCAGGCUGUCCGGAAGGCUUUGAUUGAAGAACGUGGCCGAUU

CUGUACCUUCAUCUCUAUGCUGCGGCCAGUGAUUGAAGAAGAAAUCUCAAUGCUAGGGGAAAUAACCCACCUU

CAGACCAUCUCGGAAGAUCUAAAAAGCCUGACCAUGGACCCUCACAAACUGCCCUCCUCAAGUGAACAGGUGA

UUCUGGACUUGAAAGGUUCUGAUUACAGCUGGUCGUAUCAGACGCCACCCUCUUCCCCCAGCACCACCAUGUC

CAGAAAGUCCAGUGUCUGCAGCAGCCUGAACAGUGUCAACAGCAGUGACUCCCGGUCCAGCGGCUCCCACUCG

CAUUCCCCAGCUCACAUUACCGCUACCGCAGCUCCAACCUGGCCCAGCAGGCUCCUGUGAGGCUGUCCAGCG

UGUCCUCCCAUGACUCAGGAUUCAUAUCCCAGGAUGCCUUCCAGUCCAAGUCACCAUCCCCAUGCCGCCAGA

GGCCCCCAACCAGUUGUCUAACGGGUUUUCUCACUAUAGUUUAUCAAGUGAGUCCCACGUGGGGCCCACGGGU

GCAGGCCUUUUCCCUCAUUGCCUGCCUGCCUCCCGCCUGCUCCCUCGGGUCACCUCUGUCCACCUUCCAGACU

ACGCUCAUUAUUACACCAUGGGCCCGGCAUGUUCCCGUCAUCUCAGAUCCCUAGCUGGAAGGACUGGGCUAA

GCCUGGGCCCUAUGACCAGCCUCUGGUGAACACCCUGCAGCGCCGCAAAGAGAAGCGAGAACCGGACCCCAAC

GGGGGAGGACCCACUACCGCCAGCGGCCCACCUGCAGCAGCUGAGGAGGCUCAGAGACCACGGAGCAUGACUG

UAUCGGCUGCCACCAGGCCUGGUGAGGAGAUGGAGGCUUGUGAGGAGCUGGCCCUGGCCCUGUCUCGGGCCU

GCAGCUGGACACCCAGAGGAGCAGCCGGGACUCGCUUCAGUGCUCCAGCGGCUACAGCACCCAGACAACCACC

CCCUGCUGCUCUGAGGACACCAUCCCUUCCCAAGUUUCAGAUUAUGAUUAUUUCUCUGUAAGUGGUGACCAGG

AGGCAGAUCAGCAGGAGUUCGACAAGUCCUCCACCAUUCCAAGAAACAGCGACAUCAGCCAGUCCUACCGACG

GAUGUUCCAAGCCAAGCGUCCAGCCUCAACUGCUGGCCUCCCCACCACCCUGGGACCUGCUAUGGUCACUCCA

GGGGUUGCAACUAUCCGACGGACCCCUUCCACCAAGCCUUCUGUCCGCCGGGGAACCAUUGGAGCUGGUCCCA

UCCCCAUCAAGACACCCGUGAUCCCUGUCAAGACCCCAACCGUCCCAGACCUCCCAGGGGUGUUGCCAGCCCC

UCCAGAUGGGCCAGAAGAGCGGGGGGAGCACAGCCCUGAGUCGCCAUCUGUGGGUGAGGGCCCCCAAGGUGUC

ACCAGCAUGCCCUCCUCAAUGUGGAGCGGCCAAGCUUCCGUUAACCCUCCACUUCCAGGCCCGAAGCCCAGUA

UCCCUGAGGAGCACAGACAGGCAAUUCCAGAAAGUGAAGCUGAAGACCAGGAACGGGAACCCCAAGUGCCAC

UGUCUCCCAGGCCAGAUUCCAGAGAGUGACCCUGCAGACCUGAGCCCAAGGGAUACUCCACAAGGAGAAGAC

AUGCUGAACGCCAUCCGAAGGGGCGUGAAACUGAAGAAGACCACGACAAACGAUCGCUCAGCCCCUCGCUUUU

CUUAG
```

All references cited herein are fully incorporated by reference. Having now fully described the invention, it will be understood by a person skilled in the art that the invention may be practiced within a wide and equivalent range of conditions, parameters and the like, without affecting the spirit or scope of the invention or any embodiment thereof.

---

SEQUENCE LISTING (44 sequences)

SEQ ID NO: 1 - protein, 282 aa, Homo sapiens
  misc_feature: CD74-NRG1 fusion protein
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKATSTSTTGTSHLVKCAEKEKTFCVNGGECFMVKDLSNPSRYLCKCPNEFTGDRCQNYVMASFYSTSTPFLSLPE

SEQ ID NO: 2 - DNA, 849 bp, Homo sapiens
  source (1)..(849): /mol_type="unassigned DNA" /note="CD74-NRG1 fusion protein"
atgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaatag

SEQ ID NO: 3 - RNA, 849 nt, Homo sapiens
  source (1)..(849): /mol_type="mRNA" /note="CD74-NRG1 fusion protein"
augcacaggaggagaagcaggagcugucgggaagaucagaagccagucauggaugaccagcgcgaccuuaucuccaacaaugagcaacugcccaugcugggccggcgcccuggggccccggagagcaagugcagccgcggagcccuguacacaggcuuuuccauccuggugacucugcuccucgcuggccaggccaccaccgccuacuuccuguaccagcagcagggccggcuggacaaacugacagucaccucccagaaccugcagcuggagaaccugcgcaugaagcuucccaagccucccaagccugugagcaagaugcgcauggccaccccgcugcugaugcaggcgcugcccaugggagcccugccccaggggcccaugcagaaugccaccaaguauggcaacaugacagaggaccaugugaugcaccugcuccagaaugcugacccccugaagguguacccgccacugaaggggagcuucccggagaaccugagacaccuuaagaacaccauggagaccauagacuggaaggucuuugagagcuggaugcaccauuggcuccuguuugaaaugagcaggcacuccuuggagcaaaagcccacugacgcuccaccgaaagcuacaucuacauccaccacugggacaagccaucuuguaaaaugugcggagaaggagaaaacuuucugugugaauggaggggagugcuucauggugaaagaccuuucaaaccccucgagauacuugugcaagugcccaaaugaguuuacuggugaucgcugccaaaacuacguaauggccagcuucuacaguacguccacucccuuucugucucugccugaauag

SEQ ID NO: 4 - protein, 645 aa, Homo sapiens
  misc_feature: NRG1
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 5 - protein, 232 aa, Homo sapiens
  misc_feature: CD74
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 6 - protein, 74 aa, Homo sapiens
  misc_feature: NRG1
ATSTSTTGTSHLVKCAEKEKTFCVNGGECFMVKDLSNPSRYLCKCPNEFTGDRCQNYVMASFYSTSTPFLSLPE

SEQ ID NO: 7 - protein, 208 aa, Homo sapiens
  misc_feature: CD74
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPK

SEQ ID NO: 8 - RNA, 224 nt, Homo sapiens
  source (1)..(224): /mol_type="mRNA" /note="NRG1"
cuacaucuacauccaccacugggacaagccaucuuguaaaaugugcggagaaggagaaaacuuucugugugaauggaggggagugcuucauggugaaagaccuuucaaaccccucgagauacuugugcaagugcccaaaugaguuuacuggugaucgcugccaaaacuacguaauggccagcuucuacaguacguccacucccuuucugucucugccugaauag

SEQ ID NO: 9 - RNA, 625 nt, Homo sapiens
  source (1)..(625): /mol_type="mRNA" /note="CD74"
augcacaggaggagaagcaggagcugucgggaagaucagaagccagucauggaugaccagcgcgaccuuaucuccaacaaugagcaacugcccaugcugggccggcgcccuggggccccggagagcaagugcagccgcggagcccuguacacaggcuuuuccauccuggugacucugcuccucgcuggccaggccaccaccgccuacuuccuguaccagcagcagggccggcuggacaaacugacagucaccucccagaaccugcagcuggagaaccugcgcaugaagcuucccaagccucccaagccugugagcaagaugcgcauggccaccccgcugcugaugcaggcgcugcccaugggagcccugccccaggggcccaugcagaaugccaccaaguauggcaacaugacagaggaccaugugaugcaccugcuccagaaugcugacccccugaagguguacccgccacugaaggggagcuucccggagaaccugagacaccuuaagaacaccauggagaccauagacuggaaggucuuugagagcuggaugcaccauuggcuccuguuugaaaugagcaggcacuccuuggagcaaaagcccacugacgcuccaccgaaag

SEQ ID NO: 10 - protein, 277 aa, Homo sapiens
  misc_feature: MTSS1-NRG1 fusion protein
MEAVIEKECSALGGLFQTIISDMKGSYPVWEDFINKAGKLQSQLRTTVVAAAAFLDAFQKVADMATNTRALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 11 - DNA, 834 bp, Homo sapiens
  source (1)..(834): /mol_type="unassigned DNA" /note="MTSS-NRG1 fusion protein"
atggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaatag

SEQ ID NO: 12 - RNA, 834 nt, Homo sapiens
  source (1)..(834): /mol_type="mRNA" /note="MTSS1-NRG1 fusion protein"
auggaggcugugauugagaaggaaugcagcgcgcucggaggccucuuccagaccaucaucagcgacaugaaggggagcuauccaguuugggaagauuucauaaacaaagcaggaaagcugcagucccagcuucggacaacaguaguagcagcagcugccuucuuggacgccuuucagaaaguggcugacauggccaccaacacacgugccuugccuccccaauugaaagagaugaaaagccaggaaucggcugcagguuccaaacuaguccuucggugugaaaccaguucugaauacuccucucucagauucaagugguucaagaaugggaaugaauugaaucgaaaaaacaaaccacaaaauaucaagauacaaaaaaagccagggaagucagaacuucgcauuaacaaagcaucacuggcugauucuggagaguauaugugcaaagugaucagcaaauuaggaaaugacagugccucugccaauaucaccaucguggaaucaaacgagaucaucacugguaugccagccucaacugaaggagcauaugugucuucagagucucccauuagaauaucaguauccacagaaggagcaaauacuucuucaucuacaucuacauccaccacugggacaagccaucuuguaaaaugugcggagaaggagaaaacuuucugugugaauggaggggagugcuucauggugaaagaccuuucaaaccccucgagauacuugugcaagugcccaaaugaguuuacuggugaucgcugccaaaacuacguaauggccagcuucuacaguacguccacucccuuucugucucugccugaauag

SEQ ID NO: 13 - protein, 208 aa, Homo sapiens
  misc_feature: NRG1
ALPPQLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 14 - protein, 69 aa, Homo sapiens
  misc_feature: MTSS1
MEAVIEKECSALGGLFQTIISDMKGSYPVWEDFINKAGKLQSQLRTTVVAAAAFLDAFQKVADMATNTR

SEQ ID NO: 15 - RNA, 626 nt, Homo sapiens
  source (1)..(626): /mol_type="mRNA" /note="NRG1"
ccuugccuccccaauugaaagagaugaaaagccaggaaucggcugcagguuccaaacuaguccuucggugugaaaccaguucugaauacuccucucucagauucaagugguucaagaaugggaaugaauugaaucgaaaaaacaaaccacaaaauaucaagauacaaaaaaagccagggaagucagaacuucgcauuaacaaagcaucacuggcugauucuggagaguauaugugcaaagugaucagcaaauuaggaaaugacagugccucugccaauaucaccaucguggaaucaaacgagaucaucacugguaugccagccucaacugaaggagcauaugugucuucagagucucccauuagaauaucaguauccacagaaggagcaaauacuucuucaucuacaucuacauccaccacugggacaagccaucuuguaaaaugugcggagaaggagaaaacuuucugugugaauggaggggagugcuucauggugaaagaccuuucaaaccccucgagauacuugugcaagugcccaaaugaguuuacuggugaucgcugccaaaacuacguaauggccagcuucuacaguacguccacucccuuucugucucugccugaauag

SEQ ID NO: 16 - RNA, 208 nt, Homo sapiens
  source (1)..(208): /mol_type="mRNA" /note="MTSS1"
auggaggcugugauugagaaggaaugcagcgcgcucggaggccucuuccagaccaucaucagcgacaugaaggggagcuauccaguuugggaagauuucauaaacaaagcaggaaagcugcagucccagcuucggacaacaguaguagcagcagcugccuucuuggacgccuuucagaaaguggcugacauggccaccaacacacgug

SEQ ID NO: 17 - protein, 755 aa, Homo sapiens
  misc_feature: MTSS1
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 18 - RNA, 2268 nt, Homo sapiens
  source (1)..(2268): /mol_type="mRNA" /note="MTSS1"
auggaggcugugauugagaaggaaugcagcgcgcucggaggccucuuccagaccaucaucagcgacaugaaggggagcuauccaguuugggaagauuucauaaacaaagcaggaaagcugcagucccagcuucggacaacaguaguagcagcagcugccuucuuggacgccuuucagaaaguggcugacauggccaccaacacacguggugggaccagggagauuggaucugcucucaccaggaugugcaugaggcacagaagcauugaagccaagcugaggcaguuuucgagcgcuuuaauugauugucugauaaacccacuucaagaacagauggaagaauggaagaaaguggccaaccagcuggauaaagaccacgcaaaagaauauaagaaagcccgccaagagauaaaaaagaaguccucggauacgcugaaacugcagaagaaagcaaaaaaagggagaggugauauccagccucaguuggacagugcucuccaagaugucaaugauaaguaucucuuauuggaagaaacagaaaagcaggcuguccggaaggcuuugauugaagaacguggccgauucuguaccuucaucucuaugcugcggccagugauugaagaagaaaucucaaugcuaggggaaauaacccaccuucagaccaucucggaagaucuaaaaagccugaccauggacccucacaaacugcccuccucaagugaacaggugauucuggacuugaaagguucugauuacagcuggucguaucagacgccacccucuucccccagcaccaccauguccagaaaguccagugucugcagcagccugaacagugucaacagcagugacucccgguccagcggcucccacucgcauucccccagcucacauuaccgcuaccgcagcuccaaccuggcccagcaggcuccugugaggcuguccagcguguccucccaugacucaggauucauaucccaggaugccuuccaguccaagucaccaucccccaugccgccagaggcccccaaccaguugucuaacggguuuucucacuauaguuuaucaagugagucccacguggggcccacgggugcaggccuuuucccucauugccugccugccucccgccugcucccucgggucaccucuguccaccuuccagacuacgcucauuauuacaccauugggcccggcauguucccgucaucucagaucccuagcuggaaggacugggcuaagccugggcccuaugaccagccucuggugaacacccugcagcgccgcaaagagaagcgagaaccggaccccaacgggggaggacccacuaccgccagcggcccaccugcagcagcugaggaggcucagagaccacggagcaugacuguaucggcugccaccaggccuggugaggagauggaggcuugugaggagcuggcccuggcccugucucggggccugcagcuggacacccagaggagcagccgggacucgcuucagugcuccagcggcuacagcacccagacaaccacccccugcugcucugaggacaccaucccuucccaaguuucagauuaugauuauuucucuguaaguggugaccaggaggcagaucagcaggaguucgacaaguccuccaccauuccaagaaacagcgacaucagccaguccuaccgacggauguuccaagccaagcguccagccucaacugcuggccuccccaccacccugggaccugcuauggucacuccagggguugcaacuauccgacggaccccuuccaccaagccuucuguccgccggggaaccauuggagcuggucccauccccaucaagacacccgugaucccugucaagaccccaaccgucccagaccucccagggguguugccagccccuccagaugggccagaagagcggggggagcacagcccugagucgccaucugugggugagggcccccaaggugucaccagcaugcccuccucaauguggagcggccaagcuuccguuaacccuccacuuccaggcccgaagcccaguaucccugaggagcacagacaggcaauuccagaaagugaagcugaagaccaggaacgggaacccccaagugccacugucuccccaggccagauuccagagagugacccugcagaccugagcccaagggauacuccacaaggagaagacaugcugaacgccauccgaaggggcgugaaacugaagaagaccacgacaaacgaucgcucagccccucgcuuuucuuag

SEQ ID NO: 19 - DNA, 20 bp, Artificial Sequence
  Synthetic primer
  source (1)..(20): /mol_type="unassigned DNA" /note="forward primer"
cttcccggagaacctgagac

SEQ ID NO: 20 - DNA, 20 bp, Artificial Sequence
  Synthetic primer
  source (1)..(20): /mol_type="unassigned DNA" /note="reverse primer"
atctcgaggggtttgaaagg

SEQ ID NO: 21 - DNA, 21 bp, Artificial Sequence
  Synthetic primer
  source (1)..(21): /mol_type="unassigned DNA" /note="forward primer"
cgctcggaggcctcttccaga

SEQ ID NO: 22 - DNA, 23 bp, Artificial Sequence
  Synthetic primer
  source (1)..(23): /mol_type="unassigned DNA" /note="reverse primer"
tgcgaagttctgacttccctggc

SEQ ID NO: 23 - DNA, 24 bp, Artificial Sequence
  Synthetic primer
  source (1)..(24): /mol_type="unassigned DNA" /note="primer"
ctatggatccatgcacaggaggag

SEQ ID NO: 24 - DNA, 34 bp, Artificial Sequence
  Synthetic primer
  source (1)..(34): /mol_type="unassigned DNA" /note="primer"
gatcgtcgacctattcaggcagagacagaaaggg

SEQ ID NO: 25 - DNA, 85 bp, Homo sapiens
  source (1)..(85): /mol_type="unassigned DNA" /organism="Homo sapiens"
cctgtttgaaatgagcaggcactccttggagcaaaagcccactgacgctccaccgaaagctacatctacatccaccactgggaca

SEQ ID NO: 26 - DNA, 85 bp, Homo sapiens
  source (1)..(85): /mol_type="unassigned DNA"
tgtttgaaatgagcaggcactccttggagcaaaagcccactgacgctccaccgaaagctacatctacatccaccactgggacaag

SEQ ID NO: 27 - DNA, 85 bp, Homo sapiens
  source (1)..(85): /mol_type="unassigned DNA"
gtttgaaatgagcaggcactccttggagcaaaagcccactgacgctccaccgaaagctacatctacatccaccactgggacaagc

SEQ ID NO: 28 - DNA, 85 bp, Homo sapiens
  source (1)..(85): /mol_type="unassigned DNA"
tttgaaatgagcaggcactccttggagcaaaagcccactgacgctccaccgaaagctacatctacatccaccactgggacaagcc

SEQ ID NO: 29 - DNA, 85 bp, Homo sapiens
  source (1)..(85): /mol_type="unassigned DNA"
tgaaatgagcaggccctccttggagcaaaagcccactgacgctccaccgaaagctacatctacatccaccactgggacaagccat

SEQ ID NO: 30 - DNA, 85 bp, Homo sapiens
  source (1)..(85): /mol_type="unassigned DNA"
gaaatgagcaggcactccttggagcaaaagcccactgacgctccaccgaaagctacatctacatccaccactgggacaagccatc

SEQ ID NO: 31 - DNA, 85 bp, Homo sapiens
  source (1)..(85): /mol_type="unassigned DNA"
aaatgagcaggcactccttggagcaaaagcccactgacgctccaccgaaagctacatctacatccaccactgggacaagccatct

SEQ ID NO: 32 - DNA, 85 bp, Homo sapiens
  source (1)..(85): /mol_type="unassigned DNA"
aatgagcaggcactccttggagcaaaagcccactgacgctccaccgaaagctacatctacatccaccactgggacaagccatcta

SEQ ID NO: 33 - DNA, 85 bp, Homo sapiens
  source (1)..(85): /mol_type="unassigned DNA"
atgagcaggcactccttggagcaaaagcccactgacgctccaccgaaagctacatctacattcaccactgggacaagccatcttg

SEQ ID NO: 34 - DNA, 84 bp, Homo sapiens
  source (1)..(84): /mol_type="unassigned DNA"
gcctttcagaaagtggctgacatggccaccaacacacgtgccttgcctccccaattgaaagagatgaaaagccaggaatcggct

SEQ ID NO: 35 - protein, 28 aa, Homo sapiens
AFQKVADMATNTRALPPQLKEMKSQESA

SEQ ID NO: 36 - DNA, 84 bp, Homo sapiens
  source (1)..(84): /mol_type="unassigned DNA"
  variation (1)..(84): /replace="a, t, g or c"
  misc_feature (39)..(39): n is a, c, g, or t
  misc_feature (71)..(71): n is a, c, g, or t
  misc_feature (80)..(80): n is a, c, g, or t
  misc_feature (83)..(83): n is a, c, g, or t
gcctttcagaaagtggctgacatggccaccaacacacgngccttgcctccccaattgaaagagatgaaaanccaggaatnggnt

SEQ ID NO: 37 - protein, 28 aa, Homo sapiens
  VARIANT (1)..(28): any naturally occuring amino acid
AFQKVADMATNTRALPPQLKEMKXQEXX

SEQ ID NO: 38 - DNA, 26 bp, Homo sapiens
ttaccttgagacatggacgaaacatt

SEQ ID NO: 39 - DNA, 13 bp, Homo sapiens
tagaatgaggata

SEQ ID NO: 40 - DNA, 29 bp, Homo sapiens
aaaaataatttctttttatcctcattcta

SEQ ID NO: 41 - DNA, 15 bp, Homo sapiens
atcttacaaagcagg

SEQ ID NO: 42 - DNA, 1131806 bp, Homo sapiens
tgccggattggaagaaacccgggggcaacgtatcatttatttagcgtaacattgtattttgcataatactagagtttctaaagaattttcatatatactaagctattttaatccttgcaagcatcctgtgaaataaagcaaggactctgcttatttaataaataaggaaagaggctcagcatgattcataaattttcctggagtttcaggactggcaaatagcagaattggagtgtgatgccagccaattatatccttaaactttacatatattgcccagtgtaaaagttcaagaatgcttatttctttgttatctggaaagggctgctgtaaaagcaaacctaagtgagactgtttgatcgtccatgcctgccccaaagttccaagaagttttgaatcacgtaaaaacaatcagaaaaccctgttggttttattcctttttttcctccatcccagctggactgaaatatgtaaaatctatgggatttcatgtcataccaactgtgcaaattagtggcacaatagattgtgagtttcttcagggcaggaacctttcatcttaatatttcccccttatgctgcatagtattgacttaaatacacacacacacacacacacacacacacacacacttaaagaaatggatagatggagagatggatggataggtgggtaggtggaggtgaccagggaccctaaagtctgtgactcaaggatctaggcccagttcttaaagactcatattgcagctgattttttaagaatctccccaactttctcgctaccattcgacagagagagagacattctgctacattttttctcctgggtggcctataacggttcacattcaccagttcttgtaacttgtttttcactcaaacccagcttgctgttagtctgctgtgtctaaatagtcatggatcctgcacctgctctaagacaggctgttaagtgaggcttctttcggagactgcaaattcaggactccaggcccctcagaatggttgtttcatgatttatagctggaggtgtgtacttctgtgtgctgttggtcaatgatgataaagtaggtatcagtgcctctgtgaattttctgttgccctttcataaccaccatttaggagcatttaatcaggaataaagtgctaggggtgggaaaaccatttcaggttgccattgcactgtggaggcaattgtggacttttcccccccatattttctaaactactaaaaatagtgtttcacatttacctgcataattttatgtctgctctttccctgcttgagcagataacatgatgacagcttctctgacccctaattttccttttattttcaactttgaccatggagacatgttaagccccaaggaagcactcatttttactatcaacaggtatagttgcccccttaactggtcataatgtctgctaaatagcatcaggccctagtaatccaggaggcaatccacattcccttactgaaacagagaaggggaagattcaagatggaggggatattgaatagttgaatgtcatgcctaagtattcttacacgtttacaggtttagtatgctgtggatattgatgcttataaatctcaagattttggcagttctcaaagtacagtctctatcaccagtagtatccgtatcacctgggaacttgctaaaaatgcaaatttgtatccacccccatccccaatctactgaaccagaaaatctggcggcagggccagcaatctgtgcatttgcacagatgattctgatgctcactaaaaattgagaaccactggttttaggaagtttacaaaagactgaacctttttctttctgtctttttaaaacattggtgtggacaaattaaattgtcccttttctgaacagcatttaatcatactgaacaattattcataccttttcttaagcatatgttaatcatattagaaatgccattcccttctcgtgcaaaagggcaaaatcagcaacatccttccaatgtgggtgggtaaatgaaggctctgatacaagaattgaaatgaaatatgtgtgcaaacagttcttagtactgagctgtttaaagaaggcctacctttgcacagaaaatgtctataagaattactcattaatgccacttaatagaggaagagtaggagataacgtgggaacagggtctttttaaaaaataccactttaaagaagaggcttatgcttcatcatagacaaaatgctttgtatagtactaacaggggcatatctattcctttaatgacactctaagccagtgctttaaaattttattgttgtttttattgcccctggaattccatttatctatgatagtgttggattaatgtgtggtaagcacattgccacatcagtccatgattaattagccgacatttattgagtacttaatatttgacccaaactggatcaaaactggggaatatagaaactgtcgtctctgctaacaagtttgcaatctagttggagagatgggagtaaaactcctgaaaaacttgggctcaataagataacatgatcaagagtgaggagacatgatatagactgcaaatgcagggaaagtgcactttgtggagtggtcactccagtgtttagtatgtcagaaaggaggcttcatggggcagacggatctcaaaggatgcctaagttcagcagtggattgtttgcagaaatggcctaattcttcccctgcttgtatctctgctctttggcattgcaacttttcaggtccttatgtgaagaggtagagtctactcctctgcccctggccttgtaatggtggcaatgttgacgtgctaattctgattctagacctcaagagacctcgcacatctccggccactctattgaaacacaaccagctgccatgaacaggcccaggttaagtctgctggaggaagagaccacattctttatgagatgagatgtttcagcagaagccatgggagactagatagcccccagcagagccatcaatgaggtcaacagaagaactccaccctagctgaacccagtccaaattgccaacttgcagaatcttgggctaaatgaaccaacaggtcaccaaatgttgaagtggtttgtcatatagtgacagataactgatacaaatctggaaggtagagaggaagaaagtgttctaggccagagttgtacctcccaaaaagtcgagtcagaaatatgggaggccaggctaaagaaaagtaaagaaattagtaggattggatgtttgaaccactttctttcagtaaatcgctagaagcaccatgcagggttcaagtgaacgtatactggaggccagacctgcccaactatgctgctaaatggtgatcttctcctgaagcgctccatcagggtatgagtaacagggaactccccttgccaagacacacagggagtgtgatgaccctgtccctccaaactgcactttgagagaatggaaccttgttttgtagccaactatattatgccaagaacaaaaagatctttgtagcttatcatctgtttttatgttttatataaaaatctaaagcttctatgacatactttcaagaaactgctagaggcaacacgtagaatcccagagtaaagatattatgaagttagagtactttaaaattcttcagttctcacagtgtggatctatcgcccattgaataacaactttaactgttttatgaggtcactgaatatatttttcactataaaagaacatgagagaaaatatttaccttgaaatgctaaaaatgtgttccctttctgtggaatggcatttgttgaaaggaatatcccgggagaggatggattcttgttttagacatagctctttaaatttggcaggacatgtgggggtagggggacagatgggggtggagttgggggagcttggtattcaggtggcacaataccaggtggaggttaaatacctacaactccttatgcctgggatcttttgttccaatagccatagaagcttctttcatttcactttttatttttattttttgcaaaacccattagttgacaaagtgccataaactttgtacaaaatggcctcgttcagcaaatattttattcaaactatgctcctatcagcagtaccacacatgtcataaagtcatggtgaagcaggaatttcagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgcgctctctcccagccgcttgctcgcagccccagcagccgccgcagcatcacttcacacaaaggactgtcacccgcggagcagctcctccacctccacgtcctcctccggtgacagcagccccgacagcagggctcgggcgcggcggcggcgcggggggtggggggacctgtcactccctgtaactgaggcggcggcagcggtttttttgccttttctattttgccttttttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcggtaagttcctcgcccttgggggcgcgaacccgcggcgaggagggcgcatcccgggcgcgcgggcagcggggctcgacggccgcccgagcaaggcagaggcgctctgggtcccagttgttggtttcagggtggtgggttctcagcgatcctcagagagggaggtttcgctttctccagcttcccttgtcttaggctttgccactggagaaagcccaagtttagtcctgggttggggcctcctgaaactttttaatcctttggggtttggctcaccaagtagatcggaaatgtgccggctgctttcttgtgggtgatatgaacttggctttggttaggagttgctgattctgggcctcctttgaaggaggaagggtgagtcccgcaggattttaacgccttcccttcacttggagtccagagtgtggagatggttaggggtttgcttctgtgtctgtgaagtctctgcaaggaaggggcagtgcactgacattccccgacagatgtggcagagttttttggcaactcaatgtccagcagagaggtgcagtctgtaccttgtgaatatgtgtaatatgtgagaattataaagttgttattggtgggggtttttttttttggccaagtcatctcaagaaattttgttttcacaatattttggtttggaggatgtttttgcacttcactgcatcagaacagatgaacgaaattatggaatatcacatgtaggccctgaagaagaagaattttggaagtttagcaattatttgctacaccttttcccacttaccactgaaaagtattcttcccgggtctgcttcatatgatcaggtttgagaaattagctgattatctcatttcgttgctgaggtagcattatgtttatgccattcataaactaatttctatgatctaaatatctgtataatttcctgattactatataatcactaacacatagcggggtttcttctcaaacagtaaattaacacgattacacatcacaaattccaacatgcataatagcttttccccctggtctttatgtatccgtctaatagacgtttgggttaattgaatttttataaaactcagcaccatgccaagcagagtctgcctgtgatggagagtgtgtcagttcttttaaatttgtgtctggtgggggccaattatttaaatttctggttggcatttgtggtggttaagtcctgctgttaattaatacctgatgatttggttttaatgacagcaaagatcattgttcacccaccattcccttatctgaacaatgtactttgtatgccagagacctgttaggattgcaccactcagtggacagaagctgttcagagagtggtgctgaagaaagctaagtggcatagggattccccgagacccactgatagatgtcactccaaagcatgggaaatgctctgctgggagctgtcttattaggcaaccgaaaagctcagcaccatcgtactgcagcatatgttactctgttacagaatctgaaacaaaaccttttaagcaacaccactgtccagttttcatatgttttatagtgtgtaattcaggaaggatttttcctttatcccaagtcatgagttttgaatcattcacaccacatggtgggaagttaatataaaggggattgtagttagctgtgatgcctaggattgggggtgcattactacattatcaattgtgttagttataccttttaactagaaataaatgtaagacttgagaggtaaagttcttacaagcatccagagaatgtttggaaatggaaaactcatgttgtttggaggaatcatattctattcttgtgcttctaaggggaaaaaacttcattgaaggtacttagttttgtccctcagtttgccagtcaaaagaaatataatacatagttgtaagttgtggcacgttttaaaaaaatgggtttttaatgagctggagatctttttgcatgtaatcgagtatgttaagaaatcacaaagttactgccctggatttctgtagctattgtgtgtgcttggcgatttttgtgttatatgatttaaagtaggatattgcttttaacctcaaatagatttagctaagttctaactgaaatcatgctaaaagtttctcctcgcatttttacaaacatagtgtttcttgtaaaactggaggataaaagcaaataatatcagctattttatatgatgtaaattcagtaaatctgcacttggaatattgagtgtaaaagtgtgtgtgtgtgtgtgtgtgagagagagaatgaatgaatgtgtgaattcatccagttgtgtggtgtcagataatgccattcagaatttgccaggcaaagaaacacagaaaaatggaaaagagagagagagagagaactagcaagaggaaagaatgagaatgagaatgggggctgatttgttctggttgagctgcttctggtcagaagatttcagggagagtgatggagcagaaggccctcacctaacatgaagctgccctgggggcgtgatggttgtgtgcaggcttgagccataatgctaggctggagaaggaatagagcaaagtcattttgtgatatcatacccaggggaacagtttccagctctgctgctctcagctgctgtgttgtttcctacaagttgtttgctagtgtagaaactacacatgcaacagattagccttagggttgagttaataaaaatctttcctcttgaaattcctttttctctttccccctcatctaatataaactccggaataatgtcgataaaacaagaagctctttgaaaaatggacctttggaaacagaaactatgagtgtattttagaagacaacatggaaattcatagcttaattgctttgtagttgaagtttgtataaatgacacttcctttacagttatttaaagtgtttgtagtcttcactttttctgttgctcactgaacgacctaagaaatatccttgggttttatgttcattggaatgcaggataatttgctgtccgattaaatctctattattcaaacaagtcattgtttgatgtgctacacttttagcttccaaagcattgtggttatatgaggcagaagctgatttccaaaaaggagtacaaacactgaggttgaataacatctacaattgggctatgccagatttgtacatcaattctgatcttacaagccaatataagtattttatatcatatgatggtagaatgaagatgtatacatgtatgcatgtattgataatgtaaacatctttatcaaatatttatgatacatagcacttgctctttttaatatcttcagtcactatttaataaagtgtgctaaccttatggtgttttgaaaatgaaagaaaatgctgcagagattttccagtcagcattaaagaaaactattcttaataaaagctatattaaggaaatagaaacagtaacagatatagcctgactgcttgtatgttgtaaatacacatgtaaatttaatttcccaagtgtttgtgactgctctttttaaactttataaatcttgctgtcaaaaatctataccggatttaaaatagctacttctactgagtagagaaactatgtatttatttatatgtatgttaaaaatgaaaccaacataggtcatttgggagaagaactccttagaataaaaatattttaaaaagtggatttaaatatctgagttagaatatttcactagcactaggggatcgttcttgttgttgtggggtatctataaatcctctgaatgtagggaaagtcttaccatatgtcctgatgtattaagtaagactaggagctttagacaacagagaattaaaacagtgagctgtacttcctctggcttgtatatttatagcaaatgagagcaaaagatgtgattgggcgggttattgcccttgtcaaatataatctattcattcttccggaaatctcctttgcttcgatacctattttcttcctgtttttttttcttaattataaacataatgtcttttacaaccctcttgtacatttcaatgacaatttatgaactgcttagatatccaaagatctctaaatcctcatagcaatacttagccttttatttgttttaaatatggttgaatgatctgaaaaaataatctcttttgatagctcttaatgaatgggtattttgattagctttgtatagataaatgataatgaaaacaaaaagtatacaattagggttcttactgattcaagcaatttgttaccaccccaaaatagtgcaacatggcttagtgaaagtcttcataagaaagtaaaaactaatttacaatgttcttatttcctaatcacagaaatgggcattgtggacagttttcaaccaatatatgaatactctaaatttgtgcatacatattgttactccgcttttatgttataacatgtaagttaaaattactattatgaaagaatatataacctggctagtttacccccaacctctccagaatatcagtcgctttatagtacttgaacgtttgcttagtgacacattctgttgaaatctaatgttgaattatttgtggatttacagaatatacaaattcacaaataattgtatgactaagacaaaacttggtcattttaagttgagggattgtcctagttgagaggttgtgttttcatattgcctaagttgttgagtgctgtagtgcacttcaagtaaatctgtttctgaagacttgccccctggattttcgtccctaaattatccatacaggttgaagcagataaaatacaagaaattttggtgaagttgaaggttaaaaatagattgactagtctcttcttggcatagatacaattattaggaaacagttctccctaatacagacttgccatccaggcatcctagagagagatgcatatgtggtaatttacattaatttttggtcttcttcaggagaaccaggatatttttccctacggaaaatagtttgttaggaagttctttcctggcccttgatttacctcatttggacctagtaaaatttatactttgttttaaattacaactaaaaaatcaaaaagaagaaatgttacctacagtctggatggaccgtaagagactgtcctactactttctaactcagacttctgtgttttttcttttcttcttctttatttcccctatgaagatactacaggggaagccttgggtaaatgatggggcccaggagtggattgtagtgtatgagtttaggattgctagtcattatcatatggactagccttctctcgaaaccttgaaattcagctgtccgggtccaaggaatgttggaaaatagaggtcttagatcacaagactgtgaatgcaaatggtctttctgtttctgatggagtctttgtccatcccatgaggacgtggatggtaacctgcattgcatctctagttcagaggctttctctccaaagcccaaggctctgtctttggacatctgccctggcttgctgggaacaagaaaacagctctgagtggtgcatgaatccggagctagtagccaggtttatgaggtagcaatggtccaagggaacctagaggagggaattgtttccttttcttttgctctgctgtgctagaatatgtgagctgaatcaagcccagtgcaagggaacatacctgatgagggcactagagtcttggtactgggtatacctaagagcccaggggatggacgagggataagaaatgtgaagtactgtcagcttcactaaatttggaaaatgcataccagtaatactatcatcccaaatggttgtcttttatctgggaattgccattaaggcaaagatagctaaaaaaattgagggcatactaaaaccacatagttataactaccacttatggagttggtaaatttttttggcctctttgatagacacatagagtttgatttttatgtgtagattaaattcctgttgaataattaatgaataaatgactgaaggaccccagctggttggatagtggaaatcactgttctagcctaaatttagaaagataaaaacatacttttgatttttttctcttctcatctctgatatggtgagtttgataccaggacactgttcccttctcttcccatccagagccttactgtaatctggatcgacctttggggcttcagagaaaggttgtttaatttcccaaaacttttccctcacttatttttagaacaatatttgttctgtgtagcttatagcccagcaggaaaaaaaaattccagtgttgtaaatgcttaaaagtacagaagagttttgctgtagtctatgaacccttaccactgttttcagcagaaccatttgtaaaccatcccagtttattttgggtgacagacttcagtattcagaaattttgtgttctccttggatctctcttcacaggtgtttaaccatctcagtactgtaagtgatactttatgttgaaattcattctcataactgaagatggaaaaacacagcttatatccctaagaagtaatacaaagaggttttagatcagttcctctttacttatttttcttgtttccaatatcacaacagctcttggtttacctgcaggtggggtggcatgtgcccatttgggctctgatgaataatgaggttctttgccttcacttcctcagtcggccctggaggcactgtgggagatgatgtgttatcagtgaagcagcagatgtggtggcagcattttcctccactgcagggagcatcccgtctgtacctctgtacagagcaggggagctgtctactgagaaggaaatggatggctgtgtttgcttcacatagaatttctcattagccttgggaagtggttctggcagttggggccccttggtggttgccaggatggagaggttctgctcagagtgggtgtgctcattgtcctgtcatctgcacaaagggccacagcattgagataacctaggcatgctgctgctttgcaagcccggacacctccggacaatcctttcctctgttgtcttcattcccatccatagagatgggtcacatcttgtcctcaggaacactagcacctttctttttgttggagcagaaattttataaaacaccctagcattttggaatatagttttattccgatgagcagtttagaaaaatttatggtaacataaaatttaccattttaaccatttttaggtgtgcagttcagtggcattaagtatttgcattgttgtgtaaccctcactgcaatccatctccagatattttatcttcccaaagtggaaactctgtattcattaaacactaactccccattccctttcctccttttccccaatcaccattctactttctgtctttacaaatttgactactctttttttttttttttttttttttttttgagacggagtttcgctctgtcgcccaggctggagtgctgtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctagatctcctgaccttgtgatccgcccgtctcggcctcccaaagtgctgggattacaggcgtgagccaccgcgcccggccctacctttcttaagtgtagagttcagcagtattcaatacattcgtaatgttgtacaactatcaccatcatccatcgccatactcttgaccttgtaaaaccaagactctataccaattaaattacaacttctcattttctcctcccccagccactgacaaacactattctactgtttgcctctctgatttttactaagtgcatcatttaagtggaatcatatggtatttgtccttttgtgactggcttatttcacttaccataatgtcctcaaggttcatcatgttgtagcatatgtcagaatttccttcttttgaaaggctcaataattttccattgtatgtaaataacacattttgtttattcatccatccatccatcagtggacacctggtttactttcacattttggctattataaataatgctgctgtgaaatgtcttctcaaatccctgctttcaattttttgggtatatacacagaagcagaattgctgaaacatatggtaattcttttttctttttttcttttcttttttttttttttgagatggcatctcactgtgtcgcccaggctggagtgcagtggcacgatcttggctcactgcaacctccacctcctgagttcaagtgattctcctgcctcagcctcctgaatagctgggagtacaggtgcatgccaccatgcctaagttttgtatttttagtaaaaatggggtttcaccatgttggccaggcaggtcttgaactcctgacctcaggtgatccgcctgcctcggcctcccaaaatgctggattacaggagtgagccatggtgcccggcctcatatggtagttctaggtttgctttttggaggagctatcatactgttttccatagcagctgcaccattttacattcccaccagcagtaaacaagggttccagtttttccacatcctccctcacacatgctattttctactgttttgatactagccttcctaatgcacgtggagtagtggtgagcagtttttatattgttgttgttttctatacagagttagtgtctctaattacactgtcattaacaagaagcaaaagttctcagaaaagagaggtgttcatttattcaactcttagtttaaatagcatgtaagatcctgaatctgaaaccatgaaataaggaaattacaatggataacagcttaataaaaacaatgatttaaagagtaagcttagaaataaagaattgagtaagcttcgatttaaagaataagcttagaaataaaaacaatgaaagatgtaaagaataagcttagagaatggacttacagaaaacagtcctccaaggtcatcatgagaatattgtatttttattcatattgctatcagtgtagtccagaaaggaaccttatcatactttgattagtttcagaaccttttaattgatttaatgtattcattaattgcctctaccccagcaatttccctgtctgtattcctgtccattgccccaatccccttctaatcagtacgcaccagaggctgagtcattctaaaatactacttttttttttgtttgtttcagacagggtcttgctctgtcatccaggcgggagtgcagtgggacgatcttggctcactgcagcctcaacctcatggactcaagcagtcctccacttcagcctcccaagtagctggtatcacaggcccatgccactatgcccagctaatttttgtattttttgtagagatggggttttgccatgttgcccaggctggtcttgaactcctaagctcaagcaatgctcccacctcagcctcccaaagtgctgggattacaagcatgagccactgcacttggcctgaaatgctacttttcttaggccttgttccctacttagaaagtttcaatggatgcaccatagttaactcaagatctcaacattcaatatcctccttagcctcaataaagccttatctttctcaccttcccatatgaacacttcatccactctgactgctccctgaacaggccaggcactttcctaaccctcctgtttttacatatgccatttcctctgcctcgatcttcttccaccctcatttctacctgtggaatttctgttcttccttctagggacagctcaaatcctactgcttccataatgaaactagtaatgattcctaccagggatatgcactctagaatttgaacacagagctcctctttcctgtgtaccttacacaaggtactgttacaaattttccttctgtcatattgtgtttgttacaatgtatgtattttaaaatttttctctgtttctgtgtgtcttgcctcactggcagccaacactattcttgtgtttggatactagcagggtcttcagcttacttgccagtgaaaagtgccctggcctcgagtcagaagaatcctttccactttcagctttgtagttagtacctgtgtgattgtgggtcgctgactttattcactcatttgggtctcagtttcctaatatgcaaaacgagaaggtaaaatgcttttcaaggtccgtttaaactgtatttggtcctcagaaatgacccaaacatagaaatctccttcttctggagctttttctggagcttattttctcttcctctcctcttatttagtgttgttctcaggagaacacatgtgggaaaacaactgtgaaacttttagacactctaagagaggagaaagagagctgaatgagagggaaccttcaagggaaggtgtctcttttctccaaatcttatctccatggcctttttgtgtcatttaaaaaaatattaacagttatttgcattcgctggcatcgtcttttcaaaaagcaaatatgattgcctctgcaagcctgtctttgaaatgataaagtatgattaatccacagctgtattctttagaatgagaaagttcagtcatttgtggtgctaaaatgaaaaaataaagatttgaatggttttactatttactgtgaatttatttttacaatgtagatggggcattgttttaggttctaataattagcactgttgctgaaatggatgaggtcagcacagagagtgtggagagcttggttttcaggggggtggcagcagttctaatggctgcagggcgaggcttcctgctgagatgccagtgttgggttctttctcaaattatgatttttatggtttgggcaagaaaaggatgcatttaagctcttttataagtaaaatgagcaatgctgaaacagttgtcaaatgggaataatttgatctgacttttacaatttctgcatgaagaggtattggcagctccatggcattggggcaggatgggcagggcttagctgggctaggtccattttttttttccttcagtttaacgtctccgacccctggtggattcacctactgcagaagagccaatgctgcttataaattatgtttcctcaatctatatctctagcccagacctttctttttggctctctatctgaacatctaactacttacctggtaacttatgtcctacaaacactttatgtgaaatattttaaccagtgcctcatctccactgccagtccctctgcacatttgtatcctaataatgactctaccctcactgctagtatgatcaccacagttattcccagtgacttccttggtcgacacttatttggtgccagagtagtaggcgctgagataaattcagttaacccctcaccatatggcagcattaatattttttagttacctcaaaccagatacctctcctgctccataccagattagtgaccacatcccactgattctacgtccttaacaaatctcagattcgtcccgtcttccctcacttcaacttctctgtaatagattcttactgcaactgtaacagcctctttatgcatggattctttccttctcacatccattttctatactgttgctagagtggtctttctaaaatagaatagatggtactgtgcttttacctaaagcttttcggttgacatcaggataaaactcagacccctttgaatggcatgtgagggcttttggcttttgtcccaagtgttcttgtccagttctttctcctatccagaaccttgtgctacactgatggcattctctacatatgccaggcagctttagggctctgtggatttgcacatattgttctcttttcccagaatggtctgcttctctatctacctgtttgttgtactgtcactacctgtcatttcagattgactgtccttccgtggaatggttaaataacactggatagccctataacggattgtgctatagtctttacaaatcttcttgtaggagaaaatatgatgacttagagatatgtttatattacattgtcaagtgaaaagtgttgtataatacatgtgtgattgacttttctttctttgcttttccttttcttttctctttctctctctctgtgtctccctttcctttcttccctctttctccctcccttcctccctccctccctccttcccttccttcctctcttctctcctctcctctcctctcctctcctctcctctcctctcctctcctctcctcccctcccctcccctccccttctctcccctcccctcctctcctctcctcttgtcttcccattgatctttcaataaaaataaaagcctagaactctatgtagctaaacgttaacagtgtttatctctgggtattgggattattgatctttagaatgatcttcattttgtattttctaaagtttctataatgaatgcacattactttttaacaagaagtagtaaatgctattttcaacaaaaaatactgacttgtggcaagtactatgtcttacttatctttgtctttttagaacattgccttcctcatggaagatgtattagttagggtaggctaactgcagtaaccgatgatacccttaatatataacaagtaaaatgcgatagtttatttctacctagtgaatgaacagaacacaagatgttctggtcctgactttcccctgaataaaatctgcactaactaacaccgaggcatagccaaacctcacctccagaccaaattggctgaaataggcagggttccaatttgtgacggtcatttatttttaatggcctttctattccctgaaatgtagacaaatttgccctttgctgcctcattgcagtggaagagcctcatacctgtgtgcagagctgatgatgaaaggcatctatgtgtgtatgtgtgttgtagataaatagtgtattaactatgtgtaattccttatttcaaagtagcattttatgggtgagttttgcaataaatcttcaacgtttaatgctcactatgtcttgtttcatttgatatcactgaaaatgcagagggtcaggccacattcactctgtctctccctggcatgttaggttgccttctagagctctgtgtttcacaaatcattttgatgtagagactgtggagaaatattctcaggctttatcactgctgacttaattgagtttcatgatgcgcttttttttttttcatagtaggataaattaaaaatggctgataaagctgcctgtaaaagcaaaattgttaggttaaacctgcctggtgtattaaatgtattgataagtaatttggccaccatttttaatcacttttattaactctcaagtagttttatttccagtaacttgcaaaataactgtcattatggactcagtcatatttctctttaaaatactattgaaaagtccatgaaaatgattaaagtgccaatatcatccacctacttcctgttagcaagaattgttggtgattttgtgattagctgagtatatggttgtgctctctttgtgcaacccaggaggaaatagaaccagttcatcccaggtgaatagagataatgaatgggtttgaagccgtgtaacaggagtagtcttttgtgcatctgtatcatgtatgttattgttatgctgtctttaaaacattttattaaatattgagaagacaagatacttgtgaattatgtgtaaagtgtaaagaatcatgatacgtgtaatgtgcctttcggtgtcatctttgccatcggctgttcggctttgtaaggatcttgagttcaaggtcactaaagaacagcttaacacattgtcttgctcacaggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtctgtgcagaaacaaaaaattaaatttgccaggcttggtggtgtgcaccttcagtcctagctactctggaagctgagtcaggaggatcccttgagcccaggaatttgaggttacagagagctatgattgcatcactgcactctagcctgggtaacagaataagacctgtctttaaaaataaaaaataaaaaagaattccctgtattttttccaatccatttgcatagcctccaaatcccattcctttcccctcagatttcggcattcccaccctatgggagaaattattatagttgccattcttaggatgtttcccagataaattacaggaatcataagattgctaaacaaatgtaggtggctaatagaaaaagagaagcagtaagcctacttttttcatttacttattcagcaaatgtttatcaggcatctattatttgataggctttgtactgatttctggcttgacaatgatgaagaaattagacatgcccctttctgagctaagaagataggcaaaagggttacacaaataattatataattacagttgtgctaagcctcatgagggaaaagtacaaggtcccagccaggtgaacatataacagaagaatctatcttagtctgaaagatacaagaaggtctttttgagaaagaagcatttctgttagggtagggaggaggggaaaggaggagaggaaagatttgcatttccaaccttggggcagagaaggtgaggaatagcagaaaggacagtcagcacaaaggaagcaaaaatggggtctgagaagtaaggaacaatcagacgattctagacttccaggattccagattttatcttaaaaacaggggaacccaatgaagggtttttaagaagaggagttatatgcttgtcatttcaaaaacatcacaactgctggttataaggagaatggactaaaagggaataagagtgcatgcagggagctgaggtggggccccagttgagactggatgtgtgcctggactagagtgggagctacagaagtgaagagaagtgaaagatttgagatgatttttggaagcttcttttagccttggctgtgatggggcaatgcctacaaagggcggtggggaggatggcccccagtgttctggcttgagcaaattgtatgcacagtaggtgatgcgatggcaaatactgcaggagaagaagcccttgtttagtgtattgtcgacatatccacatggaaataccaaggaagcatgtgcttgtttggagctggaggtcagaagagaattccaggttgtcttttgagtgtggtggttttggacaaggacatgacatttctagctccatgaagtagataagattgcttagggaaggtgggagagtgtaaggaaaagtgaagagaaaaggaagcataaggaacagccacctttaaaggtgaggcagagtgatgggaaagaagcaattagagcagtgaaaggaagacccaaaaaggattcaggagggaagagtggctgctgcatctgtgtccctcgaacatcctgatggaagaggaggaagacagagcccaaaccaggactttttgagtggtgactattgccacacattttaaatgtaagagtgcacattgcatttaggaccagtgaggacttaggacagagttctggccaatgccagaggtggagcccagaccaggagcagactgaagtactatttgccaacttccggttaagattgggttttagtaatatttttatttatctggacataagtagcacaaagctgttttaaatactctgaggctttctttggtggtgggggataagactgggaagaataactaatttgagagacccaatggatagtttgtataaagatatgattttcaaaaaatcatcaaaattgattaagtgttactaacgtgttgctgaaggtcactcgtttatgtgtttttctcctgagctaagaattctttcctatgtaccacctaagccctttcagtgacaaattattgttcaaatttttcttggcacactgacttgagaattaactaccattcatagctggtacccaggtcctatgagaatacaatgccttgtcacataaatacttgtgaagtgacatctatcaatctaatttagaaaaatatttgagtcaaaaggtccttgaaccatgtattaggttgacacaggagctccctttatctgaagctgtgactgagcattttaatgaatggcagtcaaggaattcaaagttattattctgatagtaattgcgtgcatttttcctgcccatctatatgcagccttctcattgtctaggaagctgctgatttgatgcattcatagctattatttgcatagggaatttgaaccaccatgggaagaatgattttgaatttcctgttttcatttatttactttgggtgcaataacagtgttttcatggaaggattttttatattgggtttttcctaattttaatacagtgtaaataagctaagtgttatatttctgaaaaccacacgttacaaatttttaaaaatgggggaaagatgaaaatgaaataaaaagatgggaagacaagttctgaaacctctgaccttacctgcgggctcctccctctagttgaccatggagaaccatagatgacttactgggccagatattctgatcttggacagaccaatggtttgtaaaatgggttgcatattatagtgtgcaaattcctggactagacttccagagatgatagttcatgtggcccagggtttgtcctgagaatctgcatttttgaaaagctctccaggtgatttttagtgtgcacttaagtctgggagctcttggaattgtttttttcaactaataaagttgaagacaccctgcacaagattagaagatggataagaaaagagaattagaatttactgagtttctattatggctgaacatgtttacatatcttacgtcatttattctttaacaccatcttgcaaggtatatcattttgttccaattttaacctgagattcaaaaaggtttacagaactttaaaggtcatgcagctgctgggaggcagaacctttatttgcctccaggtcatctgatctgctgtgtagaaccacgacaaggctgggaacaagaaggtctggatagaattctagtcacaccatcacttgggtgaggtccttttgccctctctgccaacgtgggtacctgttgctaaaggtagactttcctgtttatcatcaaagagtgcctataggtagatgagtggggaggactgcatacattttgagagtagtaaaatcagatccacttggacaaaactgtcttcaatattctacaatgaacatgccatgttattgtgaccagaattgacattgtatctctaccctacgctgacaagttgattgtctgagcgaggaaacagcactcatcatacatttatatttctccaggaaggaaaagagacatggtagagtctagtggggaaaaatctggcttcagattggacttagtacttgaattaagggtcaggcattggcttctacctctcactctgtactcatgaccttgggaactccatgtttctaaactttatttttagttttctctttgtaaaatgagaatgatgtgtctctctcagatcagtgagtaccagctgagatcatgtctgtcgagcacttaggcagtggtaagtgccttctttctttctttgttttgagacagagtcttgctctgttgcccaggctggagtgcagtggtgcaatcatggctcactacaaactctacctccctggatcaagcgattctcgtgcctcagcctcccgggtagctgggattatagacatgcaccgccatgcctggctaatttttgtattttttgtagagacagggtttcactgtgttggccaggctggtctcgaattcctaacctcaagtaatctgcctgccttggtctcccaaagtgctgagatgacaggtatgagccgccacacctggccacagtaagtaccttcttaatgttaatcagcagagggaagggagagtgactctctgcagcaggattcagtggagctagagatccagactagcaatagcagcagaatgaagatgaatcttgactacttgattgctgcatttttcattattttaggaacccagcggttctcctaaaatgcatgccaaaggtcctttgacagggtgctgctccagctgtggtttgtcggtctgcagtgttgtaccaccctggtgctcattaggactgcaaattcccaggtcaccttcagatgtaccactctccagatgtttctcatgctcactgcagtatgagaagcactactttaacaggcaacctccttccaggtgaatcatgtctggagaagttgcttggtcagagagatatttgtccaggctcagccatgctggctctgcagcgagggttccttcactagaacaccatgcatttgtggtggcagcataggtagaaggcactgagcggaaacaagaggagcgagatggagaaagaaaaaaaacaactttcccggaaaagttaaaatgatagcatgacctttctgaatggactttgggacatggcaccaagaatgagcaataatgaaataccaaggaaggagactccttaggagagcatctgggaaccatgcaaccatgcgacaagaggtgatgcagggaagctggtgagagggtgaactgaggctcccccaggggcgaggggggatacctcctttctgaacctcatgctgaacccgaccctcaggagcaacagattggggtaggagcttttggagaggggaattgaaatggccttgttggcagaatgactctgaagggaactttccagcacacccaggaaaaaaacaaaacaaactccccaatctgccagactccactttcttaactggagggcagggtggttgctcaaatattttgggctcagggctttggaaagatttcttgtcttgctgcatgctctgtggaaccaggctgagagcaggatttttgcatttagaatatcttagcagaactgggcaagatgaaaaccaatctttttgtagctaccaaaaagtggacatacttcagctttctgtcttctccctgctgacttgggtgtatttggtgtgcttgctctgtgctaggcccttcctgtctcttatctcactaaatcttgacaatatccccagagattggcatcattatactcattttacagatgaaactgtctcagaggggttacggaatttgcccaagacacacagctgagtggtgaagctggaattcagaaccaagttcggcttattagaaagtattcttatatactacatgtagaaatgaaacgcaacgtatgtgacagccattataatgtaaataataaaagtaacaggattttctccctgccctccgtaattcagtatacttgttgattatttgctgcttctggcaagctatgattgattgctgttctgtgggatatggagaagtttgaggaatttatgatacagctggggagaaaagacatattgatgcttgaccaggattaagccaccatatctcacaggtgtttagacaaaggagaaggcacctctgctaaggcacatcagggaaatctctagggaagatactgatttgacatagtactttctgggtatatagaattgtttcattttgtttgccgagtatgttaaaactgtttgcagggtgtgttaagatgatttgcagaagaatgttgcatatattattcgttttgatttggaaaaacaattaaaacaaggagagtcttattatttgccctatctttgggtaacttctgtactaacaaaactccggctcaccagccactagagttaaaattctcactaaagaaattgactaaatggaagagaatttatttctgatttcctttttaatgtaaacatatgtattgacacttttccttggaagaagtgtagtttctcttttagtagaaggaaatagaattatactctggcttaaattctattattataaacatacttctgtttttatcttgagataaggctttcctatatactgttgggagtctatagtgatatagtcattttctatattatttggccatcatttattcttttaaattcatttataattgtttttgcatgttttattgctaacatttaatagtgaccacccattaaagctattgcagtacctaagtatttataaatttttctgacatgttattgcttctggattataaactgggaaataattaagattcttgttcttgttgtaatgctgttatggtgatgatttagtatttccccaaacagtttatataatatggtctttttccacattggtatgtttctttatttgctggacagggtattttaatggttacatctaaatggaataaactcatagagctgttgatttgagaaaaccttctataatgccatattaatctatttagctcccagacctttcttagcagatcaaaggaatttcctggccactcccagaggtctgaccgccttttatctgttttaatgaaggtaattaaaattcctcagcttatgaaggtctggtcctggtcctaagtgaactagtccccagcagaatctgaaagaggactataagcaagccatttatttctaaatttttaaccttatatttctgtagatcctgattaaggtagttcctgcagtgtgagggcaaacttaggttgccagtattttagggaaatatgagttcttctttcataaactctgatgattattttgattcctgtatcattcatttgaaatgaacctgcaacactttgtgggtacataggaatgaagcaaatgcactctaaataattaaccagttgtgtcattgatttctactgataggtttatagcaaatgactttacacaaagttattaattaaatgctgtgttctgatgttgtctaaaaaatgtcatctggatgtccacagtttaaatcctcaacaaaatgttaaaagtcacagaaaaagtctttgacatagcatgacttaggatctccatattcatagttatttgttgagtaaatgtgctttgagcacttatcatgagccaaacactgggctaggtgttacagagacagtgctgaacaaagacctcgccaatatggtgcatattcccattttacaatctgtcagctcagccagtctcttaaaggccatcttttcctcaaacgagtttctgaaatgaaaatgaaaagagtcatttaaggatttaatctgagttctagtctataccctgaccacacaatgggcctcagggagaagaaggaacaagacaataccttactagagcaaaatgacttcccattatagaacatggtctggcactttcaagataaatgaagctgtaaagttaagttgtgcaattagtggacagagacaggtaatttgtgggcatggaggaggtttccaaatattcacagcaccaagtgatcaaaagctgtaagtagcatttgtgcacttttcttcatacattttacattaagaaaaaaaccatataggttgatattaagcagctaactgaaaatgaactgtccttaaaaagtaagtaaataaaaaacagcacttttcctgatgaatgaaggactgtgaaaaagctgttatgggcttagcctatgtagttcccagcattattttaaaaagatgaagaaaagaatgttgaagtctttgcattttcaatgcctaccaggtgcacctgccactcctgcatttctgggtttcacttttgtccattgctagctctcatttggtctgcaaatgtctgagtatctttcatgttccaggaactgtttgtgtgagatagatgcaatggtaaataagtcaaggtcgtcaccttttaggacctcatcctaccaacttaataggtgctagcagagactcgttgtgtgtctattataggataagtgagtgaaagtcctccttaggtaggtttcatcatctgcacttggatggaatgaatttatgaatgttcttagagacacttatagatctgagaaataaaaaacacataccaagaacttattgttgggatgaagaagagtaaataggggaattttttgggttcctcttctcctcatcctccttacaactcctcctgctgataagatatttagtcctatgattgacccagactgtcattttttggggcccttctctccatgcctgtggccaagccctgcctgggcttgtattaccagggatgactccacatgcttcttgcctgctattcacagaaggccctcttgtcttccgtgctcactgcgtggatggaacacccaggcaatgggacaccaggggtctgtatgtgctgcctgtgccagtgttctgagaagctccctgagactggtttggtgtaagggctgtcagtctgctccacaaacccagaataaattggattggaaaagtaggaaacctcatttagcttttgtgcctaaactttgtatacccaagcactgtttaccaaaaaagttctggatttggaagtagttaagtattcaaaacatattcaactatttatgaaaatgatgcttattattctatgtttatttctctcagcagggaagcccaaagagtaggggagatgaggagtaggttgtggaatcaacacccttcctcctgcctccaaaccacctgcactgcccaaggaggggccattcttttttgggagcccattatgtacttagctgtggatgagggtgtatgtgtgtcttatattcctgcttacattatggatagaagattgaaggtcacacttctgtgggtgtcctactgcacccaaaagggtattttacataaagcatgaataattgcaccttttcccccaaatgtcatatactttgatataacattttgtagagttaggagtcaggctttcatggggaagagggctgggttatgtccagttaatgggcaggcatgtagattatactttgcttttgataggtgagggactctttcaagtactattctacttcctctgtggttagtttttttctcccattcttctattctttttcatctttggggctgtacatcaggggaggagggtgctgcagtttgctattataatgggaaaaaatgagagagaaagcaaagagagtaggtaactgtactcagctttatttattttatccacacctcaagctcttattaggaaagggtgggttcttcttttctttttttttaggggggcggttttcttatagaataattactggtattctctggttgataagctaagagaaaagagagtcagggaaaagtactttactgtttttctatgttgtgttcattggttgtttttgtctgtctagtaccaaactttccaccaaccacataccctcttcacggttcccctccttccttctccaacagggaaaggcaggcaccagtggattcctctgtagtcaagacttaacataaccaggaattcttcctaaaggaagaagctatcaattagctaattatacttttcccatcccaaatttgttggacttctttgaagacaggatgatttaaatgagtggagaaggcttacctgggtggagggaagcagggagtaccaacgcatagagtgggaggaaggttggaaatatgagtgagagaaggtgttgatagtggaaggttgcagagaagttgtctgagaacttattcagagccagatggaggaattgttctactgattctcaagaagaattgagagttcttgcagcaattgttattatgtggttttgcaacttctctataatctcttataagagtagtttctcttagaagcctagtcagtatacctgaaactttaattccacttaccattataatgagaaaataaattgtcttattagattctgtgcaccaaggggcaagacctgaaaggaggatggaacggtgtgtagcggggatggcagttgatctgcaaaatcaggcatggaaattctgaactgttattggagagggaaaaggaacaagctacagttaactggtaaaactcagtcatattataggttaatcaaggccatagactgtgtgcttggtactatggaagataaagtgatatggaaagcatgatcagtgaccagtgggcttgtaatctaaatgtggagacacccagaccttagaaaataactatcccataggattatttttggcaaaatgtcaaatgaacaggtcatagataaatgatttaagaattcagaggaggtagagctcacttctacctggaagggtaagaataagcttttgttgacggggagaggctggaggtggaccttcaagggtgggtgggacagagatttgtcagcagacatgaatatggggtgctgggttgggcactttacacatcacagtgtggatacaacaccctggaaaaaccctatcactcccattttagagtaaggaagcataggctcagaaagtataaatatatgacccaaacttccttaaccattgacaggacaagttatagctgaatttcagacttaagccctctggctccaaacccatcctattccagtaccagtttgcctttatgaccttctatacacagaaatgctctgagaacaagaaagcaagtattttgcacccaggatggaaaccacatcattttggtaagggtacaggtcatttgggaaaaaatgagtgatgagtttaaacagtggtctaggtttggaaaaatagtctagaactattgaaggaatttcaggcagagaatgaggtcagccaaactatgttttagagagaagagctgcaaaaggaatgattttgtagatatggcaaatgtttatttaacttgtagcattttaaactagattacttttagcttaggtctgcatctgaaaatcagtgatttacgtagtcaacctttatgaaagttttctttgattagtcaatctagaaaagcataggctttattttttttaatttttatttctcatgcttgtgttttgttgcattgcgtttatcctggatgccttaatgaaatggtgcgatatgacccagggctctcatctgtttaactttgctaatttgctccattttcaaatgagtttccttggctgcaggagcagcagcagagcatgaactctgctgaaaggaatttcagttacaccgctactgccacctctggggcccccggataattttcttatcgtctttttgccgtttgggaacaaagccacgttgttcacgactgaaatacagtttttaaatgtgcctcctaccgtgtttttatagaaagagagcctcttctcctggaaaataaaacaccattgattgaaccaacagcccttcgaaagggctttaattattgcattaattacaaacttcaggacaaaccagggcccagtagtagggagccattgagcagatttctgagcggctttaaagaaaatgttaaaagccttttagatctaagaggctgaaattgagagaaggaggtgggcatgtgggagacactaccttcttcaagttataagctttgcattaaaaaatatcctcttccctctctgatttgtgtttcctgggaaagctccaatgactcattgctccaaggcctcaacattttctaccctgacattgatgagagagaggaaagtggggaggtggtctaaatgtcatagagtagaacttctccaaaaaaataggtcactggggaaaaaagaaatactcttggaataatcctttaacatgatcatcttcaaaatgctcactttttattctgaagaaaaagaagaaagaaaaaaggcaagtaatttctttctctggcaaaacattcactgaggtgttttcattcaattactttgatggttggctgttgggaaaattatcaaaagtgaatatgggtttgggaactactagaagattctcaaagttgctttttatgatctctttcccagggaaaataaatcattaaatactgaggtggctagatgaaattgaatgctacatctcatggtttattcagaatgggctcttccatctgacatccttttgacaggttctaccacatgtggcatttctggcaggtatgagggtaggtttcacattctaaaatgaaactggcagtcacacgtttccctggtttaaaacattttagcacttattatgtgccaaatagtgctctaagctgtcaacatgttaactcatttaatccttacaacaattttgtgaggcaggaactattataactatttagcagataaggaaactgagccttagcaaggtcacagtggagagcaggctgtccggctccagtgtctacttaattctaaccgaatactctgggagacaaagacgttcgtctcaattcatatcaccttgaatattcattgccagttgatgattgttattcttaattccctgcaaagactcaaccagtcaaacaattaatcaaatactgatttaccaattttctgggcacaagattaggcattaggagatgagtaaagatcccattcctacattaggagttcccaatctaatacagaagatggataagcaaatagggtgccagaggttggagtttgtggctcagatttgggagggttcatttatcaattcattattttaacaaagtgtagtgctagtatatgccaagcactgtgagtgattcccccatcccctgctcctcagtggttgcagtctgatcaggggagatggataagcaagcagcatgttgcattttggtgtgataattgctgtaattatgggcaagtacatgcaggggtactacatttgtaaatgtaccaagggaggtaatggcctgttcaggaaactgcactgtgacttagcatggctggagggtccagtgaaagcacagagaaggtaagaggtgaggctgcagaaggccccagaaagggttgggagtcaaggacattgtctgccatttcagagactctggactccattaggacattgagaatgttacttggtacccagcagtaagagttccttttcatccaagctctcatgtcactttaattgaaaagtagaaaagcagaaagaaagagtatcctaaaattaagcaatgataagacactgcaaatttccgaagattggaaattgccacttttatgtagagcttatggctattttctcgctggagacagactgaaaaagtgaggtccatatctgtgtctatttctgggatattggctcagcaataaagatgttagaaaaaataaaatgatggggttaaaaatcaacacatgtcacattaatttctgattcttctattggaagaggatcacatttcaaggtcaaaagatggagcagtgagatttgtagagagaaaatttatgggtggatatttgaaaattttctataagtaagcattgagaacattacgaagctaccagattttgtaattttcaaaattacaaggaatgtagtggaattggataatggatggtggaacctcttattcttggatcattggtttagatagatcccagattggcaataatggaaatttatttcaattttatgtctgctcagtggctgaaatgaagtgggttaataggtgcagttttgctttttgtggaggaatgccctagtcacagaaacccctaaagcaaactggcctttatatccccccagatgtttttccaggatgggtagtaacagagagggatatctctttgtcttggatttcctttatattgtgtgtcaaaatggacagtgtacaaagagtactattcaaaagtgtgagactaatctcagtttattgtgaaattcaatggatcacaaagtactgtgtccccaaaccaaaacagatgattggaaaattgaagactagatatttggaattgcttgaatgctggaggatggtgtgggcaggggtggaggcctgggtttctggcatgtaaccctaaagtcctttttatctttagtcttgtattctacctgagtagtaggtattgtgaaaagtatgttttctatgagtttacagatacagttcctggcataatgtacagcatatagcaggaatcctgtaatcattgaaggagttaataaatgatatcatcagcatagaacagtttggctgctttatgtataactcaggctactacagattgggtatctcttatgggaaattcttaggaccagaagtgttttggattttggatttttgtggaatatttgcttatacataatgagatatagaggggacgtgatctgagtctaaacatgaagttcatttatgtttcatatacaacttatacgcatagcctgaaggtaattttacataatatttttctttttctgttttttgagacaaggtctcgctctgtcaccccaggctggagtgtagtggtgcggtcatggctcactgcagacttgaccttctgggcacaagcgatcctcccacctcagcctccctagtagatgggatgggtctacaggcctgcagcaccatgccaatgcccagctaatttttgtattctttttttttttgaaatggagtctttcccttttgcccaggctggagcacaatggagcaatcttggctcactgcaacctccacctcccaggttcaagcgattctcctgcctcagcctcccaagcagctgggattacaggcatgtgccaccatgcccggctaatttttgtatttttttgtagagatggggttttgccatgttgcccaggctggtctcgaactcctgggctcaagcaacccttccaccttggtctcccaaagttctgggattacagacatgagacactgcactcagccttatacaatatttttaataattttgtgcatgaaataaggtttgtgtacattgaaccatcagaaaaaaaaggattactgtctcagtctcccatgtggacagtctgtggttttttggcatcaccgtcactcctgactctgaatttatatgctactgataagctttgtgttcttacacttattcacgcataagtacttaacagtaaaaaatatgacatgcatatctggtgtgcacagaaaagatatatcacagatgaaggaggctgggagggccttttttcccttggggacattgaataaagcatgtgtgtgcacctgtgttttgattgcgactggtcacatgaggattgggtgtggaattttccacttgtggtgtcatgttggtgctcagaattttcagatggtggagtatctcaggtttcagattttcagatgagggatgctcaacccataaacccatatagagataaggagtcttggtacaacatgtgctttatagaaaggaaaattttaggtctcagttgtagacttagagaaattcaggactaagacatttctgtgcatttagttccttttcatttttattttcctaccaccttcccccagccagctttcatctttttctctcaaagctctgcaaatcattgaaaaaattttccatgttattttttaggacaaaaacttactaaaagtcatccatccagcactgagttcttactcacgggggtcaccactgctgtgttctagttcctttgcttttgttttgttcactggcccctcctctccaatccctgagctcctacactgcaggccttcctttttattttacgttttacactctcccaacctgactttatcctttcaatcaaagatcattaataaatcttgtattgccattacctcataaaataagtattccatttaatcacattatctatgtatctgaaatcaggaagataccgaaaggtggtaaacaggaaatgggaatattggcagaaatgtactactgtacagctgagaattgtcattctctttgtttttttttttgtcgaaaataaaccttctgacagagatgatcagagaaagggatcataagtggtttcatatgaatatcaagattggctcccattacattttggcactaggtgttaagtttttatctctctgatcctgataggtggtggtacttggtgggcagtgtcatgaaaaccaagagaaccagggccttatatttcttttattttaacttgggtttttattttttttctttgcaacttttatattatgttcaagggggtgcatatgcaggtttgttacttgggtaaattgcatgttgcaagggtttggtttacaaataatttcatcacccaggtaatcaacataataaccgataggtactttttcagttctcacccttctctcgccctcaatccacaaataggtcccagtgtctattgttcccatctttatatccaagtgtactgaatatttagctcccacttataagtgagaacatgtggtatttggttttctgttcctgtgttaattcacctaggattgtggcctccagctccatctgtgttgcttcaaaggccatgatctcattttttttaataactgtaaggaactcaaatcaacaaacaaaacataacttgagttttgagaggtgttttctaccagatacttccctttgaactttgtatgtgacttcctagagagaaagtgtgttgaggaagttcactattctattctgcagtgagagaagacgacaggctaccagggaaaaatagaagatcaaaacctttttatttatttatttttgtttgtttttaaagtatctgtttccatatgtatactattgtgcaaccaattagttggggatagcggatttttatgtagctggcaaacttatcaggcagaagagaattatcatgtatatttcagcagcaatttatgaacaggtttgtttctaaaggatgcacatgtattttgggtttcactcttagtttcactctgattaatttgcttaataaatcttccttcttaaagacagaggagaggcaaacacaagtcaagcttttgttttagccagtagatttataattaatgacttttgttgatttaagaagctttctgaacaattcttggaatgcagtggtggcatcatgaaaggagcaaagggaacattttcgtgggacataagtaagatttaggagagggaggagttcacagactatcattaattttacaggaggagaaaatcaatgtcagtaggaaaaaagatacgtacaaaagatgacttctggatttgaggaaccattctcaatagcagaaaatagagctgttctcaagacatatgttaggtctctcacaatctatcagcaataaaaaaagatagcaatatagagatgaaagaggaagagagaagaaggattaagatcagctgtcaaaatgttgcatacaaaatgtattgaatgtcactattataagaggtcttactgtaattaaatttcctgtctatttggatttgctcatcttaaagctttttcagttgtcagtgtgagaaatgtttcctatctaggtgttttttcctccctgttaagtatcagcacagtgtaattcaccatagttgggtagggtggtactgagaatgtttcctacctcagcaagcctaatgtatatgattgctttttgtgaagagttttttttccatttctaccattaacaaggtgttagacacttagcttggtagtagacaaaccattagatcaatattcccagaactagagagttctgatattggcaggcattatttattccattaaaaaatgtcatattcatttaacaaagatggaatgcagatagtttcaccgaagccatgagtgtgataaaggctatagacaaaagattcctgtgaagtgaccatctggaccagtttaggtgttaggatttctgaggttcttgaacaagagctgttcctgctagctcatgttttagaacccatgtacaggaaaattgaggttgtgtttaaaaaatatggcatgtagcacaggaaatatgtgttttcagagcaaatgataacttaatattggctgaataatttgtaagaatactgatttttttgtcatataacctatatattttcttaaggaagataggtttataaggaaaaattgcaataattaaactgagcataccaacaaggaaaaataatttaactattatgatgactcatttagttggcatcctcgagtaatgaggtgctctagattaattttcctgagagcagaaatatatccctttaaatgattaagcattttatcttcatcaatctttgaataatatatttccaagatatattttacattcctttgtgtcataaatatgctttacaatgtatagggctagaatcatagtttttttttttttttaagagtttaaagaaacactgggagatcttggaaaataatattaccacattggagtgcaacattcttgtctctgatatatgaggttttgattagatgatcatcaaaattccttctctttctaacattctctaaataaaaagtcgtttatgttttaaattgtagtatatataagaatcagctagggtctttgttaaacttgcagatactcagacatcatccctagaggttctgatttagtagatttggtgggagagaagagaatccgtatcataaataatcacctagagccattctgatgacctcatttagagaaacactgattctctttccactcttgtataacagacaccattactcttgctggccacgtggtccttgaaaagatcattgctgctttaccctcagtggcattgagttgtgaggggctgatgagactaataactatgctttgatagtctttgctttctgaacctttcctcagtattacctgtcactttgttaatggtagctactgaggaaaaccagatcatcaagcttattaaatcagatgccctgtacttgtacatttaataagtcattgagttctaatcttaggtctgggtagaggcaggggaaggactgtctattttctcctgtagtctaaagtgcatgcatttagcagtgatgattatattccctgtttggaggtcttttactcttttgtcatgttctggttgttttaagaaagtcaagttttctagaagcatgacgtcagaataagtggcacattactctataaatatcttaattttcatggtgagattcatagtcaggatggtctatgactttcaaatattaaaaatttaaatataccataaaattctcctttaaagtatactgttcaatgatttttagtaaaatctgtaaatttagagttgtatgaagccaacaccataatctaattttagaacatttccatcatcccccaaaagaaatcaggtaactgttcccactcctaaatccagtcaatcaataatttacttcttatctctatagatttaccttttctagacatttcatatgaatgagatcatacagtatatgcccttctgtgtctggtgtctttcagttagtgtaaagttattgaggttcattcatgttttagcatgaatcagattgccaaataatattctgttgtatgcagttactacattttatttatccatttaccagttaatggacatttggattgtttccactttttgactattatggctagtgtgttcaaatctttgtgcagacatacattttaattctacttgagtagttttacctaggagtagaacttctgggtcatatggtaaatctgtttcaaggtagcagtttcacatgttacagttctacccgcaacgtataagggtttcactttctctacatccttgccaatacttattattattattggatacaagtcccttattggatatatgattttcaaatactttcacctagtcagtgagttacctttttactttctgaatggtgtcctgtgaaacacagtatattttattttgatggatccccgtttatctttcatctatgcatctgggtactttttttttttttaaagaggaatctttaacccaatactcatgccttcttgaggcttactcaagatcttgtaagctttgtttagtatgaagtccctagtgatacctagcatatagcacctagtttaaacagattacagatgaatattcaaagtttttgacctgaatttactgtagtcaacagttaccctaaagccttaaagattaccaaagccatgatagactcagccaccatcatgcaatggctatgtccttcgtagcatcctttcttcacattcatctttgctttcagcatatgaaggggggaatgtaggtctttaatttaccttgtactgtggggtagcactatcctttccttactccattttcaggcccttggatgcaggacccttctctgaggtcccacagaggtggaggcccagcctgagcttttacaggttttagagtaagatgtcaggacagcagttcacactcagccacatcccattaaaagaaataaaaaagtggctgggcacagtggctcatgcctgtaatcccagcactttgggaggccgaggtggatggatcacttgaggtcaggagttcaagaccagcctggcccacatggtgaaaccccatctctattaaaaatacaaaattagctgggcgtggtggtggacacgtgtaatcccagctactcgggaggctgaggcaggagaatcacttgaacctggaggtggaggttgcagtgagctgagattgtgccattgcactccagcatgggtgacaaaagcaaaactccatctcaaaagaaaaaagttgctgctgtagagttttgtcataagaacatactggctgcagtgtccataggcaaagatgaagctttactgagggctgatatactcaatacttctgcccagtccacttgagtctgtctttgcctaaatactaaattgtttgaattctcctttagttttagattttccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattagacccgtggctaatctataagcagtcatttatattttaaatgaaatccattaatgatatattcactttctagggcttatttccatctcaagcttccatttctgattgtaatgtgtaatgttgcatttcctgtgaaaggaattccaggctttggattgtaggtgggtaagattagtggtgggtcttagagagtcgggagatcctgagcatgggaacagccttttgcccgtaagtttatactgtgctcaaagatagtctgaatagttttaggctgcctggggtcccaaggagactttatgcctcccgatagtaaattttgggtccccaaagacccaacaatatttccatgcgatcatagcttgaccccaatttatggatgcttccttcctttcttctttaatccttgacaactttcttccccaagatttcctcgtgtcagggacccagaggccattcttactatgatctctttcttttccatttcattccctatggcttagaccatttaggtggggcagtggttctcacagtgtgaaccactcatcagcagcaacagcttgttaaaaatgcaaactcaggacccaccccatatctgcttaatcagaaaggcctgggaggttgaaccctccagtccgtgtttgatataccttccaggggttctggtgcatgcgcacatgtgagatccacttgtgcagtggttaagagcaaggattctggaatcagcagccaggtttcaaattttagctctgccatttggcagctaccacttcctgccatccatttacctatatgatctttggggaaattactttcctctctagactttaatttcctaatctgtaaacttgtggaataaaatatgaattacctacatgggaagttgtagaaatgaaataaggtaatgcatacaaagtgtctcacgtgatgtctggcactctgcaagcatccctgaatgggagctttcatggttgatatggactctgaccctagtcattgcctgcacagtgcttgatgaccttcccttgcttgtctctagcagcttggcatttaactactcaattctaaacctgaatgtttgccatgtgctccattttcagtagtatgaaaatgagactagttttcacactaaaatccctgtatgaaatatatttgaaattttgcttaggtcttgcttttgttttctgccacccagccagtttcctatctgggataggacatcgcttttgataataattcaatatttaaagcctttgtttaagaatgtgtcttaagacatgtttaaaagtctaaataaacattatatcctgtctcaatttatctaccacttaaaaaatttcaagtgttttttatctatctatgtctatctattgatatagaatctatgtagggatatagaatctatggattctaaatagattctatatagatatggataggtttgatatccctatctgtggcttttctcctataacatttttctaacttaattgtcagaatctgttctctagtagaaaatccaccgatgtcagaggatcacttgagtctgggaatttgaggctgcagtgagctgagatcatgccattgcactccagcctgagtgacagagagaccctgtctcaaaaagttcatcaacatacagtatacttccaacaaatccacagtaaaatttaatgtattggatcattttcagactcgcggcagccagtccttgggctatttctatgagtctttatgtaactttgactacaaattcgaagttgtcctcaaatccactagaactcctggttggataccattcaatcctggtgatttattttacttttatttgtcagttaggcctagtacatcccttgcatttatttttcctgaatttagcatatttagactgcttacttcagaagagaatttgttttcaaatattctctttggtaaaatatacctcagaagttggatttattccctttcctatcttttattcatctatgtactgcacttatttttataagttcatctgattcttcagctggctttctgccaatgataaattaaaaaaaaaaaactacacataaacgaaaccaacaaccagaaaacccttttaacttgttatttatttatttatttattagcaacctttaaactctttgaattatgtcatgaatttcctctgacttacaagctcacagggcagcattttctaatagtgttttgttttagcctgaaataaaaggttccatggtcaagttagcataggaaaggctacatacttattctatgcccctttatcccctagcctctgaaacagtttagtaattcataattcacagtagcatttgaaacactctgagatgtcctgcatagacaaaccagattaacttggtttgacctaatttcccccccaacataaacacttattaacaatctgtgaactagtgttccttagaccacctttgtgtccattgaatttagaagttttcttattctcatttggcatagcttaatgtttttagatgtgctttagttttttcctctttacctatttgtttctatttggtttcttcacttacgctttttccatatatatttttttgacaagtctgtgtgacccaatttaaacttttctgatgacatttactttgaattaaaaaagattttttgttcattacttatcttcctatattctatattgaaatgattattttaatatttaatgttatagcatattaatttattaaagtattaaatatttatattattaaatttattttaagttaaataatcaaataatattgatattaaatatttaaatatttatatttaaataatatttaattttaactttatattgatataaaattatttaaatattgataaggatattactttggtagtactggtggttataatgtttttaactgtctttcttattcactgaatatattcactgactatttcatggtaggtttttaagctttattgcttttattagggaataaatgactaaagttatatattaacatttacatttgtaagttaatcttcaccataggtaatttttgctttttaaaatttgttgcagtactctatatttccttgcgatacttactctctttgcacatgcttcttcttttgcatgaaggctcttgttccagatatccacatgtctgtttcctttcctccctcagttctcttttcacctgttgtcttctcaatgaggctcatttttgctgctacatttgtttttagatgtatttgtaaacatctagacaccctaccccaacactacctattccccttcttgacttcatttttattttttgtgttgatcaatatgtaagatactatgtatttcttgtattcattgtatttatttgttctttcttaatagaaagtaaacttcccaaaaacaaggattttcatctgttttgtcactgctttgtctctgctgtctagaacagtgggacatattttaggtgctcagtaaattttcaattggatgaataaatacaataatctcagaagatgtaaaaactgcattccataaaattcaaaatccattcatggtacaaaatcagtgaactatgattaaaaggtaaaaacattgagcaaacatgatatttattggtgaaacattgaaagtattcttttttaagattacaaacaagttaatacatctttaatcagcaagataacatttctatgcagcattattatataggaaattctagctaaaacaatacaataagaaaaagaagaattattagtattgaagaggaagaaacaatgctatccctagtcttagaggatattttgtctgcatagtaaccatcccaaaaaaatacagattaagtattagaatgaataaaagaggttatcaaatatgccacaaacaaaatcaatgtacaaaatcaattgcatttctgtactttgctacaaatatttggaaaaggtaacaaaataccatttatagtagtatacaaaatataaagtacctaggaaaaactcttagaaaaacaggaaaagacctgtgtggagaaaatgataaaacaaagatccttgagaaaacctaaatgagtggtaaaataaatcatagttctgagtagaaaaataccaatctacaaaagatatgattctcctaaaattgtttatttttattttttatttttttattattatactttaagttttagggtacatgtgcacaatgtgcaggttagttacatatgtatacatgtgccatgctggtgcgctgcacccactaactcgtcatctagcattaggtatatctcccaatgctatccctctcccctccccccaccccacaacagtccccagagtgtgatgttccccttcctgtgtccatgtgttctcattgttcaattcccacctatgagtgagattatgcagtgtttggttttctgttcttgcgatagtttactgagaatgatgacttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaacaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactactttacagtcccaccaacagtgtaaaagtgttcctatttctccacatcctaaaattgttttagaaattttatggaataaaaatataaaaattcctgcacctttttactcaccatggaccatgcaagctcattcctgcccgcacacagaacagcgaacagggagttttgccctcccagatattaaaactgtgtactactataaaaatagcaattaacacagtatagtattgagtagaaaaagaaaataatagatgatttcagacagactagaggacccaggaagagacccacacatttatgtaaaattctttataaagacttgactcttaagacaggtaaatgcaataaatgctacatgacaattggttaactaagtggagaaaaaaaatggatactacctcacatcacacataaaaaaatcaattctggttgcaagacaaatctaggaaattgttagaaaaatatatataagaagatagctttatgacctcagataatgaagaattttaaaaacaagatacaaaaagcatgaaccatatgggaaaagatttagttttactacattactaccctatttatccttgttaaaatgttcagtagctccaaatacaatggaaaaaagactgggaccagtgtctcacaaaagagaaaacacaaatggctaaaactaatatgagaagatacacaacctcattagcaatcaaagaagcttacatttaaatgacaatgacatatcatgttccagccagtatattggagaagctaaaatgagtaatagcaagagctgcagaggtatgggagaaacagaacattgttagaaaggaagtaggttgttagaactaatttgcaaagtactttgactttatcttgacaagtttaagataccttaaatcccatcaattccattccaatgtatagactctggagagcttttatatttatatatgtttatatttattatatattatatataattatatgcattatatatattcacacacacacacaggagatgaccataatattcacagaatacttgcttggaaaattttagtagactacttttagagcaggtttaggatcacagcaatatagagcagaaaatagagttcccatatagccttcatccccacaaaagggcaaccttttcactatcgacatcccaaaacacaattgtgtatttgctgcaattaatgaacctatgctgctgcatcagtattacccaaagtccatagtttacattagggtctgctcttagtgctgtgcattctgtgagttttgacaaacctttaatgacatgtatctgtcattgtagattcctatagaagagtttcacttccctaaagagcctatgtgctctgcctattcatccctctcttcccactaaaacctggcaaccactaatcttttcaatgacttcatagttttgccttttccagaatgtcatatagtggcaatcatacagtaggtaaacttgtcatattggcttctttcgcttagtaatatgcaattaaggttcccaccagcactgaattcccatcagcaatgaatgagagtttctgttgctccacatcctcgccattatgtggtgttgtcaccgtttggattttcaccattccaatctgtagaatcattgttattaattggggggagagacaaccaacaaataaaggaaataactcagaggttcgttagcagaatgattttaaaaattgagggctgtgcatataataaagtgacataaaactatatacacacattgtactaaagtcgatttgctgttttgatattgtactgtaattaggtaagatgcaagcactggggaaactgggtggagggcacatgaagcttctccatactatttctccaactttccgtgtgcctataattttttttcaaaccaaaatgttaaaaaaaattcgagtgttgttttctcatagataaaatactgtccagctatggaagcaatgaaccacagataaaaaccacagggctacatctcacaaacgttatatggaataaaaaaatgcagtcgaataaaaacagatgcagtataatgctcaaaacatacaagctaaatgatatattactttgggatacaactgtgataaaactcaagaaaaacaagtgaatgataagaaacagaattggtgataatgcttatctcaggggaacccccacgcttttgtgagttttacatgcaggagactatcaggtcctcatagtgaatatcggagaataattcagggggattggaaaaggaacattttgaaatataccagagcattctgtgtattcttattaactaacccgccctcgggagaaacgatcttcctagagtctaacctgctgaggttttattagagcctaacatacctgggctaagagaaaggaaggaggtttcatacaaaatgaagcgttctcttaccacatgatccagaaatcacactccttagtatttctccaaatgagttgaaatgtccacacaaaacatgcacatggatgtttatagcagttttatttatgattgtcaaaacttggatgcaaccaagatgttcattagtaggtgcatagagaaaaaaattgtggtacacctagacaatggaatactattcagtgctatcagtgctaagaagaaatgagccatcacgtcatgaaaagacacaaaagaatcttaagtgcatatcattaagcgaaagaagccaatctgcaaaggttacctaccgtatgattgcgattatgtgatattctggaaaaggcaaaactatggagtcgttaaatagattagtggtttagtggggagggaagcgtgagtaggcagagcatgtaggatcttcagggcggtgaaactattttttatgattctgaaatgatggatgcatgtcattatacatttgtcaacacctataaaatgtacagccctgagagtgaatcctaatatgagctatggactttgggtgataataatgcttcagtgtaggttcatttattgcaacaaaggtaccactgtgctgggggatgaccatcgtgagggaagctgtgcatgtgggtggggcaggggctatatgggaactctcactactttctgttctatgttgctgtgaacctgaaactgctctaaagtataaagtttaaaaatttaaaaaactctgatctttagtttagcattttacaatctattttattgaaaggaacaaataaaagttaggattaagagaattaaacatttttcatagagcatataaatatagagcatgtaagagaagacttgattctcatttcagttctgatctgtctttaactttggcttagctggttttagctgatggtttttgaaggatggtccccagaccagcagcatcaataccaactggatatttgttagaaatgtaaattctcagacctcaccccagacctattgaatcagaaactctgggagagggactgctatggcttgaatgtttgtgttccctacaaaattcatgttgaagcttgatctccaatgtaacagtattaagaggtggggcatttaggaggcaatgattaggtagtgaggtctctgacctcatgaatgggactagcaccttatgaaaaggctggaaggaactacgttggcctctttggcccatcaatctcttctgccatgtgaaaacatagcatcaaggtgccatcttggaaacagcactcgtcagacattaattctgctgggaccttgatcttggacctcgcagcttccagaactgcgagaaatacatttctgttgttattattacaaagtgtcaggtattttgttatgcagaaggaacagactaatacagggactcagcagtttattttagcacaaggcttccaggtgattctgatgtgcatagacttttgagaaccactattactttcaaccttttcatctataaaattataaataacactagatcactttttttcaacgtgtgatgtatatattactgatcatgtgcaggacagttttaggtggcataaataagagcattttaagttttaccagctctgtatttattttaaagtttgttagaaaaatataaatagcataccaaatctacaagttcactggtgtttttgcctcatatatggctaagttaaaaaaaaaagaaaacaaaaagagaatcaatggaatcaatttgaacttgatataaatagaaatagccaaaatagtaaggtgataggagaatatcacaaggtgcatggagtaatttctcaaattttgaggccttagtaaccctgcactggattaatctcctacgtattttcattctaaaactatgagatttcatatgctcgtttttcttacagatttgcctccttaattttctttttaaaattcaagctcacatattaaaaatgtagtcgatgctgtttgagcttggaggggaaatggcctattagtgtgcttttgtactgggggatacttatctgagattcatatttaaccatggttaatggacatggggataattcacatgcaaatcatcaaagttaaatatattaagaagaaatctgtcctgaaaacaccatttaattttagaagcattttcttcttttcactacttgaagtatttatagtggaataggcagatgtttttataaaaaggaaatgaaacgacatttggggacagtaataaacatattttggttaattagggatttatactttgtaaaagttttcacattataaatagctaaaacatagctggcctttttaagtggcagtttaaacagctttattgagatataatttacattgtcatagagtccatctacataaagtgtacaatttagtggttttgtgtattcacagagctatgcaaccatgatcatgagcaattttaggacatgttcattatcccaaaaagaaaccccatgttcattatcagttactccccatcccccatgtagttccaaccctaggcaactacttacgtactttttatttctatggtttttctcattctggagattacatagaaatggaatcatatatgaagtggccttttgtgactggcttctttgacttagcatgttttcaagattcatccatgttgtagtgtgtgtgtgtcagtattttattcttgaataatattccatggtattgatatatcatgttggtctatccattcttcagttaatgaacatttgggttgcttttactttttgctatataaataatggtactatgaacattcatatacaagtttttgtgtgaacatatgtttttatttctcttaggtgtatacctaggagtggaattgctgggtaacaatacttaatacttgatggtaactatatttaataattcaagaaattggatataaagcactcttattcaaagtaaaattgcgattttatttaaaactaactacatttctgttttaataaggtatgaattttgtttgtcaaggattttacataaaatctgtctccaaaatggtgtttggcaaaaatcattattaaaatacatgtttttgaacacagcagcttacagactgctattctacatcacagtttatcatcatttatcaaaattgtcatgtcctctgtgacatgtttctttttctgaatattttattgtcacatgtgtcattaagcatttagaaaaaaaatggcctggaatcttcttcctgaactgatgaaattcatgatttttgtgtatagacatttacaaataaattatatgttgttaagaaactaatggtagttttttttcttttaaaattctcacttcaacatcaataaaaaatgtttctgaaatggaaacataccattttgatgtctaactgcatctgacacttttaagttttgctgtcctattattaatattttaaagttttaggaagggctactttttatataatgagattttatattccataaattattatttgactttgttttactttgtcacaatgcttcttcaaagcttttttgccaaattggctacctttagattcctttttaggaaaggtcttcaggatggtcttttttgttgtttttgtttttgtttttgttttttgagacggagtttctctctgtggcccaggctgaagtgtagtggtgcaatttctgctcactgcaacctccgcttccttggttcaacgatttctctgtctcagccttctgagtagctgggattataggcgcccaccactacacctggctatttttttgtatttttagtagagatagggcttcaccatgttggccagactggtctctaactcctgacctcaaaggatctgccagcctcggcctcccaaagtgctgggattacaggtgtgagcctctgtgcccggcccaggatgctcccttttaatagctacttaggaaattaggttttggtaccttgttgttagaagagaatattcctgaaaaaaggaaacaactaaatgcatcgactatctggggtagtagaaagagaagcgacagcacagagaaaagatgccccttagggaggagaaagaaacaaatatcaattagacttgaacgaactaggtttctttattgatgaagaaagttaagccacactttaactttccttgccacactaaaagcaaacaaacaaaccccaaagaatagtcaagcagctgagacattcagtagccttgtaggcaaaacaagacatattcttattgttggagtatagttgtgtaaggcctgtagcccctttcttttgactaatttattccttttggaatgaaaatatttactcaatgcctgtacctgatctgcagactgatcagctgaaatcatccttgattttatttctgatagggagaacctgtcctgcacttaccatggtagagtagtgggtgtttataatgaagatgtaaaactttatagtttggatcatgtgggaggtagactctgatacagggcttagagtgtttattagggagtgctgttggaaacaacacaatggaagagaaaagaatcaggatcagacagatggaagagtcaaggtgtttctttggccaacaacatggaagctttagaactgaaatggttaatcagtttagtgccatgtttggccaaagtggccaggtctttgtaaaccacctccattagtaaatggatgcggctgtcacctcccacccaccagagcatgaccttaggtcaggcgttctctgcagctcagactgttccagcccctaaaggggcttacagctgggattgtcctctgacaacactccctacatctgggccaagaagttcttccttgaggattggtcttgatggtgtttctcctatgtctgctgcactacatcagtcattgtccccttaaccttcacaaaagcttttgaaaatatttatattttttgtttataaaagtggtacaattagacaccaatctgtattcaacagggcaatggttaaatccatgactttggagactatgtgtgctcttgtttgaatgtttctatctcccccagatttatatgttgaaacctgatctccaaagtgatggtattaagaggtaggacctttggaagatgattattagatcatgagggtaaggctctcatgattggattagtgcccttatataaaagggccaacggagcttgtttgtcccttccaggacatgcgaaacgcagtgagaaggaaccatctgtgaggaagtgggccctcactcaatctgctggtaccttgatcttggacctctcagtctccagagccatgagaattgaatttctgctgtttgtaagctacccgtcaacgatattgtcctagatccgcccaaatggacaaagacaatttagaattaacataatgaggaaatctgtgtgtactgatgagaaaatatgtccatcatgtcatagactaaaaaaaccagtttgccgactatacacatatatacactatgattatatttttatttacaaaagctatacaagtatgtaaaatacacaggtacgtgtagattcactaaagcttttaccttctgaagactgggttgggggtaaacaagaagagagaatgatagttttcaatttttgttttgtatgctcagtttatatgttcatttttctgttgctgatgtaacaaattatcacacatttggcttaaagcaacacaaattgtttatctcacagttctggaggtcaaaagtcaaaagtctgtcttactgggctaaaatcaaggtgtcaggagggctgtcttcccttctggaggttcaggggacaatctgttttcctgccttttccagattctagaggctgccttcattccttgacttgtgacttcttcctccatcttaaaagccagcagactcacatcttcaaatctctatctaactctctcttccgcctccatcttccacttcaagaatccttgtaatttcatggggcccacccagataatccaggataatttccttgttttaaggtcacatgattaacaatctaaattccatatgcacctttcttaccacttgccatgtaacataacacattcataggttctagggctttggatgtgaccatgtttggtggggtgttattctgagtactacactaggtaagtgaaactacagctttctcacaacctatgtgctagctgttcatgcttcctgttcagataataccaggtaaatgagagaagagaaacatccgtgggtaaacaattataatttagtacattattattctttaatttctatagtatttataataaagttcaataagaatttatctatgaggaagtggcttttctaaacaagtgtaaagcccccttgtttggaaaaatgtcagagagactgcatactttttcttcttgcccgcttttcccatgctggcctctgttgcagctcttctgaaatgtaatcattgctttatttctttatttatctctttcctaattttcttggaggttctttaagatgggggctatatactttaacttaccaacctattcaatgaatattcattaagtacctattatggctaactatttttctgaacatttgggatatataaattgataaaaaccaataaaaatttcacttctttaatggaggaaagacatcctatatagagggtgatgaatggaaataaactagaacaggtcaagaagaatcacaagtgccaggtttagggattgtttgtaactttaaataggttattagaataggccccattaggatggtgatatttgagtaaaggctttgatgtggtttgggtgtgtccccatccaaatctcatcttgaattgtagttcccataatccccacgtgtcgtgggagggaccctgtgggaggtaattgaatcatgggggttttacctccatgcttttctcttgataatgagtgagttcttgagatctgatagttttctaaggggcttttcctccttttactccacacttctccttcctgctgccatgtgaataatgatgtgtttgcttccccttccaccataattgtaagtttcctgaagcctccctagccatgctgaactgtgagtcatttataaatttcctctataaattacccagtcttgggtatttcttcatagcagcatgagaatggactaatacaggcttggaggagtttaaggagttagtcatggggtgtcagagtacgcttcattaggaagatgctatttgagtaaagactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagatgttgaatacatactgaagggagccaagggtgggaggtgatccgagagagtgatttttctggtgtggatcagggtggtagcaatgaacgcgatgtaaactcatcagattgtggatgcgctatacttggaagatagggcaagtaaggtttgtggacaggttggttgtgggatatgacagaaagaggttccaaggatgatttcaaggcttatagtttctctaattggaaggaggaagttgccatcaactgaaataaggaaggctatgatgagcaggtttggtagagaagatcaagagtttgtgttgggcctgttataaagttgagattctataagacttccaagggtagatggtgagaagacaatctccagatatatgaatctggagtttaggaaagaggtctggaatatgtgtaaatatgggagccatcagcacataatagatgctgagtgaacgaagagactgcctgagattatcaaatgaggcatagatggcttgagaatgagactgaggttggagtcctgggtcactctagcagagattagggtaagaagggaaaccaaccaaagagagtaagctggagccctctgcaccctttttgacagcagtaggtagtagatgtttatttagtggataaatgcccaaagaggaggtaaagtagcaaatgacaaaggggaattttatctgtctatgtagaataaattaaaaggtgaaaaacagaatcaactgtatttatctcatcagtgaatgggtaggaagcaagtgatggaaattaacataaaagtagatctgaggccgggcgcggtggctcacgcctgtaatcccagcactttgggaggctgaggcgggcggatctcgaggtcaggagttcgagaccacggtgaaaccccgtctctactaaaaatacaaaaaattagctgggcgcagtggcgggcaactgtagtcccagctactcgggaggctgaggcgggagaacggcatgaacccgggaggcggagcttgcagtgagccgagattgtgccactgcactccagcctgggtgacagagtgagactctgtctcaaaaaaaaaaaaaaaaaaaaaaaaaaagatctgttcctttttactctataaatatatttgtttataaaaataaccgttaattttaataagttaaagtgtttttttcttatgcaattacttctttttaatcttcatgatgcttaatgtgctggtgtggctaattctttgaaaaagtatgtaaaaaaatcccttctctacagagatgaatctagttcttcagattggttattcctatactttttatttgtttttgtttttgtttcagagacagggtcttgctctgttgccctggctggggtgtaatcacagctcactgcagtctcgacctcctgggctcaaggaatcctcctgcctcagtctcctgaatagctgggactacaggggcacactaccacactcagctaatttatttattttttgaagagatgaggtcttgctatgttgcccaggctggtctcgaacttctgggctcaagcaatccccctgcttaggcatcccaaattgttgggattacaggtgtgagccacccatgcttgaccatgtgaatatgaatatactggagaatagcaacactaagtagttgaaactcattttagaaattaccccatgaacatatctaaattcttcataatgagtcatagaagaatttctaaagtcaacttggtaaaatgtactgatgattttcattgaaaaagcatgattttgctttcatatatttaataatttgtagaactttcaactttcactgtggtcttaactggtattaaaggtgatttggaaattgtattgagcatgtatcttgctatagtataaaagaagtagacattttccttaagaactttatattctaggttaaacagttaaaacacttatataaatatacatataaacagtttagttgagaaaatataagatgatgtaattgcaggtctgtttgactcccacctatctcttttgagagaagaatttataaaagaatagactgaaaaagtggcaataactataaacttgcattttgacaggaagaagaatagaaaaggaagcagaatcagctgccttgatatggatacaagttctacaaataggacagccactatgcttgaatagtagtagttcacatacttcacgaagtaaattaaatgtgattatattgggcctgacctgttggtgagaagtggatgtctcagcgtggggaggtgtgtaagcttgctcaggaccaaaaagagccctaggtagtgaaatctttgtgaggggttggaacctgaataggaaatagcatttaacaatgctcatcttaaaaccgaaaacctcagtttttttatgagtatgttaagaatctctgaagatacaacctgggttggacgattacccaagatctgttacatatttaacatcagggaagttatgcaaagcttattattgtttcttgtgtttattttgggtgctgaccttcagaaaggccttagctaatctccaggtcaaagcctatagtgaccacccttgctgccgctgcatgccacacctccctctctgtgctatcttgctgcatttagggactttgttgtcatagttcctctcttactgcaaagggattccaaagctcttgaaaaataggaagtagctcatccttttctatgggctgaggggagcagtccttgatttacgataagaaaattctataatctttggacctttgatagaggtgacaaatacagagatctttcttggaatataatttgtccaaaactattttgagaaagcacacaaggcattaacatttacatttccaattaaagcatagggaaactgtttacaacaaggggacagaagttgatgctgttgtttattgtgttatatgctggttatagaccctcgttttacagttatttctctaaaatgcagtaaaaaaaaaaaagaatgcctagcaacatagcaacctctatgaaatgaggcatatgctgtttctaagactcacaatatgtttttctgaactgtttgctcataaacatgtttattgtaggtgctgcttgggcagggacggctttcctgtagaaatcctctcttgaatacactaggttctggttcctcttgtggaagaatgaagctctttttgactgccttggaaaatttgatactttcaggtatttatgacataatcaatggctgatatgtgtcttcaggatttatgactgtcctgtcataaattgccgtagtttcagagtgcatacaacatcactgtctttttattactgttattattggagacaggctgtcactgtgttgcccaggctggagggcagtggcgaggtcttggcttattgtaacctcctccttgccagctcaagccatcctcccaccttagactctcgagtaggtgggactataggagtgtgccaccatgccttgctaattttttaaaaaacatttttgtagaaatgaggttttaccatgttgcccaggctggtctcgaactcctgagctcaagggacccacccacctcagcctcctaaagtactgggattacaggtgtaaaccattgtgcccagcccactctgtcttttgaggtggtgggaaggtgagatgtagtgacacagatattctgtgtaccatagtgataccttatttatgaatcatcttgctctctctcttgaagtctctctatgctagaaacatcatctgatgtggtattcgacacgggttcaccttctggttttgtcactaaatgctttatgactttgatctcagcccttctctgtgtctagagaattgttaaattactaaattaaaatgaatttttgagagtcttttgatgtcacaaaatgtaatagctgctgagtgcccaagtatatatcaatttttctttagtgaagaagatgcagaagtggtaaaggagaggctgcttttggagagggcagagtgagaggagatggaagtttggaaatatgtcttataaggaaggccaatgaggaggcaatcattctgtaacatgtacttgtgatctagtaaagcttgtgttttgtatagaaggctatgtaggcttttatgactgggaacgtgtgaaaataatgacctagagccaatggggcatagggacatttgcggcatctaacccaggtctttttcattcccaggctagggggctacaattctcttctgaaagttacttggcatgatcatcttgctgttcttaaagcaaaatagcccaaattttgttgaagaaatgttttagagaaatgattgcctcatatttctaacaccactcttggttatttgtttactaaatagctttttattgggggaaaagtgtatggaaatttaagttggggaaattacttgggagaacttcttaatgtattagtctgttcttgcactgctataaagaattacttgaaactgagtaatttacgaagcaaagaggtttaattgactcacagttctgcaggctgtacaggaagcatggttggggagccctcaggaaacttacaagcatggcagaaggatgaagaggaagcaagcaccttcttcacattggcagagcaggaggaagagagtaaaaggagaagtgctacacacttttatttatttatttttttgaggcagagtctcactctgtcacccaggctggagtgcagtggtgcgattttggctcgctgcaccctctgcctctcaggttcaagtgattcttatgcctcagcctcccgagtaggtgggattagaggcatgcaccaccacgctaggctactgtttatatttttagtaaatacggggttttgccctgttggcgaggctgatctcaaactcctggccttaagtgatctgcctgcagtggcctcccaaagtgctgggattgcaagcgtgagccaccatgctcggcctacacacttttaaatcttttaaataaccagatctcatgagaactcactcactatcacaagaacaacaagggggaaatccacttccatgacccaatcacttcccaccagatccctgtcccaacattggggattacaattcaacatgagatttgggtagggacacagagccaaaccatattactgaggaacaacttaatgtagatagtttctgtgtatgtgtgagaataaagttttcttataaaccattctattttttaagttcaactattttatcttccttaaagataggggggttgaaagttgattttatagtttgagctcttgttatttttcaaccattagccaataaatataagtggcaattatttaagaagaataacataataatcaaatatgagaaatataagaagcttagaattgtggagttggaagggacaagtcacctcaatttatagtcagcatttatctaattgttctgccccccttaactgtaaaatggcaaaagtaatacttgatccataaatttcttttaaggattaaaagataatggattaaaagataatgtatacattcaaaaatattttttaagtgttttgtttgtttggtttgttttttcaagacaaagtcttactctgtcgcccaggctggagtgcagtggtgctatcttggctcactgcaacctccgcctcactggttcaagcattctcctccctcagcctcccaagtagctgggattacaggcatgtgccatcatgtccagctaatttttgcatttttaatagagacagggtttcaccatgttggccaggctggtctcgaactcctgacgtcaagtgatctgcctgccttggtctcccaaagtgctgggattacaggcgtgagccacagcacttggtctattgagtgtttagtatgtgccaaggcatatgctggttcagaggatatatctgtgtactagaaagaagatcctggctttactaactaggagggaaaaaaactttacccggtgatgacaaaggtgataagtacttccacagtgctcactgggacaaagtgtcagaccttacacagtacctgatactaggggagaaagagggatggacctgatgtgtcttgggtgtaaagtatacccattatataatcctaacagcaattctgtaaacctggtcttattttccttccttttacagatgagcaaacttgtgttcttgtaggtctgtgtcaagtaatgtttgttaaataagttaatgtgtaaatggaaacctgagcagttgtgcaacatgcccaaattcttcagcaagttagtgacagctgggaccagagctgtttctgacttcagcccaggggtcctttcattattctacactgcctctcagagtgtgcataggtgtgtgtgtgtatgcatgggagataggaaagttgcagtcttatatatgctacacttatcaatataaaaattatttcacaaaacacaaataatagtgaagtcagggctcctagtttaatccattttaattcctatcactagttacaggtatatttaattatccagatacgttgactttgtgctgtggatttagtgtactaaataacaggatccaaatctgtgaagttttctttttctggaaaactactggctctgaagcaatttaagccagaattcaaggccattcatccaaaatttaaggtgttctgaaatagaaggtgtatatatcactttacttaatgtgtgggttgtgtgggagacttttctttgcaaattgaatcattggagaccaatgatcctataactgcatttgaaatccttcagctggcaaacctttggtagttttaatttctttctcaaagaaaacatctgttataggtgtctgtagtctagttgtgtgtgggctaccatttcaattagtaaagctataatgacagtcttgggattttgtagaaaccctagtaatagatagaagtgaacatttctaatcctttattatgatcccgttatcaatttcaagtcagtttcttccctatgccatctatccaccaactcccagctgtcttgaaagaacatatataatatttttctaactttagggaatttcttttaagtttgagggcctctttctttttgctaggaagggaagccgggtcaggaaagcagaggagttagttttggagggccctccttttgtgcatcatttagttgcagacctaagcaatgtctttaatcccaaggaaatgatacaacactcctggagtcttccacggttttcagaaggtgagtattcactaacagtacctaactctgtcccttctgtaatttatgtggactctaaacattgctgtaaagtactgctggagaaatacaagacttgtacatttttcttttcttttcttctttccttccttccttccttctctttctctctttctttcttttttttttttgatggagtttcactctttgttgcccaggctggagtacagtggcacttaaaagtcaacctgaatcgcatttttctccagtctgcaatagtttgcccaaataattacagttttaagtcttttaaatggttactagtccttccagcacagaaaggtgatgcagccccaaataatgtgtatgtcggtactgtcactacagtgctttgggtcgaccaatctcatcctgacttctgatctggagtctactgtcatagaaaggtataatatgcttataatttttctcccccaatatttctttgcttctctgtggcagtatttctcccccaaaacacttagagatgtttgattttatccttgcagctgttataaggcagacaagctcgagctgacacacacagtttctctcatgacaaggaccaattgtgatttatgaccatttacaggatgctagtgatgtggggaagggtgtgtttttagctagcaaggctatgtcctttcacttggaaataaacaacatgttaaaaatatgtagcagggttaaaaagaggaagcttcactgtaattttcgtttagtgaagagcccttaggctaactttctataatgttcagctaatgtgtttatatcttcaaatcatcttaacaaatatttattgactgcctgcttcttgcaaggtgttatgctggctgaaatgaaagttttcatgaaaattctaatgtatagaattaggaagttagaaagcggggttattagcatgggtctttgtctgctttagttgaatagaacctgttatgaagcaatacattttcctccaaaaatttggcttctttagcaagcagcatatcaactaaagatgaaagaaagaagtggaaacatttattcacttgtaatgttaatataaatctttgttttcatcagaaattcctgaaaagctagattataatatgttacagtacaaccttgggtttggcttttagcaccaaggttaaacaaagatttatgaacacaaaagatgctgtgaaagctcagattcctgctaaaccttgaatgtcctatagtcctctaaatggtcctaaatgtggaaaaatcagtcttctcattggttaggacccactgacttccgtcattgtaattactgtgatataacctgtagggtatgagtgattaaataatttaatatcactgggagagttacttattatgtgttttatttgtatatttgcaagcagttcttcatttctcatgacagttcttgcattcatcatttactaaaatggggttctgagttaataacatttttttcctcattataaaaattctcagaacaagtcaagatctaattagacatcttcaatttattaaatcagacctctttacagagcccttttagaagcccaggtaacacttgttgttttaaatcactggcccaacatagtcacatgaatataccttgatgcaaagaagacggtgaagatgtaattttttagcctttgcatattaaaaaaaatcagaattctgatagtaagaaaaacatattgtttagttgcccaagttgtgtctttttctccacctctgatttcttcccaatactttgatgaagtactctgatgaagtactcccaatactctggcgattttctttttcttacccactataaagtgtggtgtttgcacttcatgcctgagtctttctttctgagaagaggctcctgcaagtctttggcagctttcaactacattaattttacaggtccatccttgaagcaaaactttaaaaaggtattttatgcttttttccttcctttttttaaaaaaaaaatttttcaccttttaattgtcagttctaattatctgtgcaaactgattcaggcagaaacatacaattctgagagaaaaagggaccctgggactgacaacctaggtttactgagtgggagaggcagaggtgcttcccaaataaaaactgtggctgttaccagaagaagggaacagggatgctggaaaaagaaaggacagacatccagttctggaaggtttatttggcttttattcataaaaatacgaaaacctttccttggttttctgctcttaatcttcctttaaatacatcaactagacatagtcgatataggtggttcttgtaagataaaacctccttggccccatgcaggtactctcctgatatttatacacagaattgcccatgtctcttaaaaaagagaacatctgatttgcctttaagaaaaatgtgcaggatggggtgggaatgagggtgggtgagggctttacatttcatgcagttgcagactttttggaggcagcttttactctctgggtcatattttaattcctgatcctgaagtggaggggaatcctgatgttagtgtctgggtggtattcttgatagacttttagttgaataagtaaggaaggatgcttacatgaacaaaccttattcagtgtcccagtttctgagcagcccaaggcaccaaagcctaacctaggatgaggatggtttgtgtggagctggtgaaactacagctcccgatctcatccaagattgttgttttccatttgctgctgaacagctgtttgtttggctttccagcggcatgaatatgcccacataatcacaaactcctagatattgaggcatcttaatgagaacatagcctgattttggaaggaatggaatgaaggaggccaagtgaattgcatcagggtgcctggtagaaaaactggcattagaacctcgattctatgctcactgtccgtgctctgctccagtacatgaaatttgtcagagaaaatgagatgaagcaccatggtttcctatgccctccctgtttgttcctggtacttaaccaacctaaaatctactcatggatctgtcaggttttagatttagtaacaggctcattgactatggaaataattgggtgggggctgaggtctttatggtagattcaagtaactagagcaagagtagatgggttattgtggtagaatgagggacatttgctagtttaaatcacatttctgcagtttgtggttggacttggagcttctttttctctgtagcttagtagcagatgcgcttttcgctgctggagcaaaactacctacagtagtgtgaatcagcaagtagggagtattattagtcatgtgaattcagatacttcctattgccaaaggcttgatatattcatatcttacattttatcttctctgtgacgattcattacatgtagtgagagcatatacttagtcttctgtgtggctcaactgggggcacatttggtctagtccaagtaattatatgtaacgtaaaattacatacagcacagtcatcaaagaagctgtccttccttcccctatcactaagatctagggtgactctggagtgccactgtgtgaacatttctcactcttgtgagcatgtttctaaatcccaaatcaatctgacaaaggattttctgtgaatttcttgttaatttcttgacataaaagctcttatgaacatacatattccgaacttaattctttgtttgagtcaaaatcatttttattcaagagggaacaattatattaatctagatttgcctggtaaatccataacatacagacctgaagttcaagcagaacccgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataacagaaaaagaaggaaaaaaaatcaatacaaaacaaccatttacttatttcccagagtaatgcttctcaaactttagcaatgtgcatgcaaatcacctggcaatcttgtaaagtgcagattctgattcagtagtggtcaggcagtgattctcaaagagtgttccttggagcagccttgttggaacaactgtgagcttattagaactgtaaatttatgagccccacctaacctattgagttacaattttattagatgggcccaaaaagtgttttaggaagcttaccaggtgattcttattcacctgaaagtttgagaatcactgacatagaggagattctctggagtttttctcaggactctggtattttctactgtcactgggcttacagtatacagttgatctttagcagtggaaacagttggacagagatctttatttaggctcctgaatggctgtcggcatcttgaaagttgactggcttcattaaagtctctatttcttggtcctttgacatctattatgataaccctgatactttctaaagcagacatgccacttcatggaatcacgcacctcatggaattccatgcacttcatggattcatgcacgttagcacagctagacacctttatgtggcaattgggtaatacttactttaaaagatagaataaaggaaaaactacctaaaatttcccataacatttttttttttttgcagacttttcaggggtatggatactatatgggctttatatcttcatatcagcttagtcctagttaattgttattttcaatcatattaatggccattggtcattgctagccagtatctatgactggctggttctaatggctacaagcatgcttagcagtgccctcatgaatgttgctattattgttgaaggaggaaaacattttaataattggaattggattttctcagtattcagtattgcaaaaggtggatgtaacttcttatgatgtctcaacagctattactttattttttaatttatttttaaaaatcttattgtcacaccccatgattctgcaacagctataattttaatttctgaaagttttgatgatttcctccaaggctatagctggagaaatgtacattgtctattattagtaacatttctcaaattgtttacaaggcctgcagtatagatgggctgagactgtgtttatgctttttcattgagaaattttggtcttgcagaaggaatccatttgttctgtgaatctctataaagcaaagagaagagttcaaaatttataagggagcccaacaagtgttccaaaaaaggctatttaggcacaacatttaggtgcttatctagtatgttgtttctatcaatacatagcttaaatataaatagatctaagaaccttagttaagacgaaagggtatagcataccatgctataaaatctgtcatacagaatacacataaagtgtctgctgtaattttgtaatctttccaaaagcaatatactgtgtctacagccctcatttacaacttatagaaatttactcattttatgcagaaaattggaaaggagcagatgtttattcctaagctagaattttgaaggccaacaattaaaataaacatgtctctgccaaaacttgaactaaattgaaaaatttagcatataaattaaagctcacttaaaactaaatttatcaaggaaatacatttgttttgcattgctggtttcaattattctgaaaggacttttatttttatggaacactgaagatttttaaaagtttcaaacaatttattggacaattgcaccatttaaaatgagttacaaatgtcttgcttaaatgtatgagctattagcacatagttgatgaccttatagagagacattaaagcaaccatatcctcaagtttatgtctatattcccaggggagtacaagaaactggtctgtagacctgaaatagataaagctgtgggcagcattctcttctattcatttgttcctttggtcaggaatctgaattttgagacatattcaataaattatgcatactcaaatatttgtgctcttagcttattgccacagaggaaaagagattatttcctactttttagtatctctctgcttttgtctgatttgtacaatgttgcctaattaatttttcttaaacactttgccctccacacattttgcctaaaaccttcattggctcttgtaagatgtgctagcattctagggtctcagtttactgttgctaccctacttaaatgaatctccaatgcttcctaattgttacttcttggcttcaaccaatccaatgagtttcctttctctgacacatatcagatttatgcaaagtagtttcttggcttaagttgccctatatttctacaaaggtctagtcagatggtcagatgtgactatctctacatatgggtctgaaatctagtttaggaattctatgctgtgaatgttttagcttaaaactctaaaatttaactagttttttgaattctctctattatattacatgcttctggaataaatataaacacaatgaaatcctttcttgaaaatttaggaagatgttatacacaatataaataagttgtaagatagtgatttctactagacagttaaggtattaaggactatttgtccttgtattaaatggacccaggctatgcctttctagtgtttttgtatactctgattttttagtggctttccattaaatcctgaaagctcactactaagactcatgacattttttggggggttagaaaaattactatgattcagggctgggcgcggtggctcatgcctgtaatcccagcactttgggaggctgaggcaggcggatcatgaggtcaggagatcgagaccatcctggctaacacggtgaaaacccgtctctactaaaaatacaaaaaattagccaggcgtggtggcgggcgcctgtagtcccagctactcgggaggctgaggcaggagaatggcgtgaacctgggaggtggagcttgcagtgagccgagatagtgccactgcactccagcctgggcgacagagtgagactccgtctaaaaaaaaaaaaaaaaaaagaaattacttactatgattctctctctcaaataaaattctggtgacttttctttaactcaccaaaagtagatacatacatatttctaattcattgtttgaagaaaagccttaagatattttgaaataaaattctacacacattacacagaacttgtagctacatgaggagagcaaggtttttttgttttgttttgttttgtttttgagacggagtctctgtctgttgccaggctggagtgcagtggcgcgatctcggctgactgcaacctctgccccgccgggttcaagcgattctcctgcctcagccttccgagtagctggaagtacagtcgtgcgccaccacacgcagctagttttttatttttatttttatttttagtagagttggggtttcaccatgttggccaggatggtctccatctcctgaccttgtgatccacctgctttggcctcccaaagtgctgggattacaggcgtgagccaccgcgccccagcctgtttttgtttttattttgtaaaacggccttctccacgctgaaactctctctcttttgctctttcatctgtcatctcctccccactcccacaccccacactcctttacccaatcttgccactgcaggacaagagataggatgaaagttggaaaataataatttatggagaaagcctgtgttccttgctttatgaaagtaaattgtagataattaatgttgtgacaagatgattctattttgatgaataaaatcattgaaaagctatcaagccccactgtttctctgctgagagaactttttttcctctctgttctgcattcctattcttggctttcttcccaattagtctctgctaaagagtgataattggggagataggattttcacctaccttgtgaacagtaaaaatacccatttttccaccactgaagctatgtgtattaatattctatgctttcagaaagaaaatcccacactactgtgattcctgcttaaaaaaggaggtaatctaatgcccaagtaaaaacaattttatggtacttttatgagcttctgggaacaatggccatgtgatgttcagttgcgtgtttcatgtctgatgactgagttcacgtacgtcttagaggctaaatttggtttaaaatatcttacatcttctcaaattccttataacaagagcagtaaattaaaattaaatttcgaccttaaatggattgcatgttttccatttgtaatatattcgtatggttcaaaaatctgaaagagtaaatgagtacatagtaagagatttccttcctacatccccatcttcccagctccttttactccccctcccttctgcatgaaaactactgttactagttttttatgtgtccttccagagttttttctgcatatacaaacctaaaataaacatagattcttattctcctactttttacaaaaaatgtagcacattttataaatattttgcctcttgatttttttcttgcttaacataatatagagttatttccatatatacatacatagggacatttcttaatttttttatagctgcatatcatttccttgcactgaagtaccataatatatgtatatttcacaattacctgattcatgtatatttgactagtttcaaatcttttgatattataaacaatactgcaaagaatattatatatgcataattttatacagtaggataatttcccagtattggaattgctaggttagagtacaagtttatgaatgttgatcagcattgtcaaattgcccttgtatagggattgtgcttagttcggctcttaccaggcttatatgagattgttcctttttcctcagccttaccaatagagcatgttgtcagcctttggcattttgccaatgtgataaatacaaaataatacattagcaaatttttaacctgtgcttttcttattatgagtgaagtaacatattttcatatatttgagtgatgttcctctatacatgatttgtatcttttatttttttcaacattcaaatattttattgttgatctttttattatttatttctataggcttcatctaaattgcaccttttcctgtgatataaagtaaaaaatgtttcagaattatatcatttgtattttgactctgagtatcatctttttttctatttttgtttttttgtttgttattttctgaagaattggttgaatttttctagttcatttttcttcgtggcttctggatttttagtcataattagaaaaggctttccccttccaagattataaaggaaatctcctgggattttttgtacttttgtattatctttaatatcacataaatctctgattcatctggaattggcttgtagtaagaagtttattttttctttatatgacttaattattgaattgactatctttttcccactgatgtaagatattacccttattatacactaaattcttctctatgttgagcaatagttttgaattttctgttcaatctctttggtctgtttatttatgtgccagtattcagggactatatgttttaacatctagaatttctaaactacctttaataactgaaattgctaagctgttttcctatttaaaagtttttctgaatattcttttcttcttttttctttataaacttccagattaacttgttttattcaaacagctggtgttttaaaaatagaattttattacattttcaaattaaattgctgtctttatgatctcgaaatttattctcaaaattatgatattactttttcagttgtgtaattccctttgtttcctctaatggtgctttaaatcatcatataaatcttgcacatcaactttatcagctttatctcttggtattctatctttttcatcactgttgttagtgatttctatatgttgattttgaattctattttactcatcttttattgcttgtagttgtttttcagttaattatcttttatcttccaggtgtataatcatagcttctgtagtaaataattcctttgttttcctctttccaaatttgtatagatttaatttggttgtaactcgtctaatcgctttggattgtacctagagatcagctttaaattttatcagtgatcatctttttcttgtttctgacttctgggattctaaaattttgtcataaagcatgataatggtttttggtctcggttggctgtattttattacgttaatgaagtatccatctgtacagtcctagagttgtagctggacctgtgaacaccaccttaagacacgcatttctcagccccgcttgtatttaagccttacttgtatcacctagtgattcatgtgtgcccatgttcttgccattgtaacgtaagtaaaagtgatacttgccatttcttccacatcctttcttttcccttcttgctggcaggaaaccagaagtgatggcaacccagcctcaactatgtaaaggacaacaaggccttcagggatggctgaccatgagatggagggaacctgggtcccagaatcacttcgtggaacagactactcccctgaacaacaacttccgattattacttgagaaagaaaaataaacataattgtttttttttttttttttgagacggagtctcgctctggcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacataattgtttttaaagccattttattgttgagttttttgttacacaaagccctttattaccatgactccacatttatagttgacccttgaacaatggggttagagggttaggggcaccaaaccccagtgctgttgaaaatctgcatataatttttgactcaccaaaaacttaagtactaatagtctacttttgactggaagccatactgataacctaaatagccaatcaacacacatatttcatgtattcatgacacacgtttttcttaaatttttctatatttctagtctgcacagcaaatctccaagcaatttttatgtatatttattttttaaaatctgcataaaagtggatttttggagttcagacccatgttgttcaaggttcaactgtagtccttttttttttaggtgattttttatttaatcaaatgatttatttttttttaatcaagtgatttttttttttggtcaaaaacctttttcatctatggaaattatcttgtgctgtatctctagatatattcatataaattatattaatggttttacaatatttgaccattcttgctttccctggaataagtcacatttcatataacgaattatttgttcaagtgcttctgggaatgtttcaccgatattcatacctaagattcgtcagctgtttttgtttcctgcagtctttataaagttttgatattagtgttactcttttttgtagaggaaagaataattttttaaaatttttccttgttctggggctattttaaaatgctggaattcactgttctttaaaaatgtggtagaattttcctagaaaacttccaaggccagaggtttcagagtattaataattggcacatttctctaattcatttgttgaaatcagattatttagagtttctatatcctttggggtcagttttggtgaattatacattactagaaaattacatatctcatccagattaaatttattttggcatagagctgaataaaatagtctcttttggcttttttatttttctttgtttttgtggctttttaaattcttattttcatgtttgtagtttgttcatatttccttgaatagtttagctgtgcttcatacattaaatatttttcttaaaaaataatttttaaaatgtatttattctattttttccctaactccataaatattaactaccctcttctccttttccattgattttttgttcttttctataaatttcattcagaaactcaatttccttattttctttattcttttaaattttttaataaaaattaaatgctctgagttttcctttgagcagtgctttagctatagctcatgaattcaggtatgatgtttccattaatattatatattcagatatatcagattgcataactctttgaagagggaattgttttggagggggttttaaaattaccatgagaaaatttttatttttctccagttttatcaatttctatatttaatgtatcatattaagagtatgttttcgctgttatttctagaatttgcctatttctgaaattttctttatagcctcatatgttatcaattttaataaatattccataaatccataaatatggattgttgaaaagaagataggtctttttatttctaatataaagtatttttggtatatcaaacatccataacacattaatgatgctactctattctcatagcttgagagaagagaattactctcttctcactagtgtgtttctgtctcttatttcctgtaatttcaggtttgtgaacattttgctattcataacaattttttgtgaattacactctcttgagttatacaatgttgttttttgcatcattttgggcctaaattcttgcttgtctaatatgaaaaataagaccatctacttggattcttttctgttttgccagtatatctttttccacattttaattttaattattgtgaatcagtttgttctagctattcttttaaacagtattgagcttggttttactttctcattcaatctaaatatctttgattttaacaagtaaatttaattgattgatactgatatagcaggtatgtttgttctgagtgctgccatatgttaaattttttgctttcatgtttgctttatgttctttaacagtctttcattatgttgtctgtgtacttccctttgttttaagtatacttctgatatgtgtgaaggtgacatatttattctattggctatctttataatttagttgttaaccttttgtaaactatgtttgtacttctatcagtttttttgatctgctttaatgatattacttgatttccaggaattttagtaaaataatcaacaaacattttcaacttcctaatttcttttcccctccttcgcatttttaaaaattttaccagttctgcttggcagagcacataatattaacattcttttttggtcatcccaaccctcaaatcttttctattatttccccagtcatatttatttggctgaagaccacctactactgtcgtcaagaaagattaaatcatttttgtaagtaaaagctgtttgttgcctttattcctaaaggacaacttgactcaaactttctttttctgaggatcttgtagatggtgctgttaatacatgttttatggtgttaaatgcaactgtagagaaatctgattttcatgcttataagtaatttactgtttttgctggactaccttacatattctttctttaccatttgaagttcaataactgtctgggttgtctacactgggttagtttttccttgcctccagtgtacctttcaatatgtatagtattattttatttcaaagacttttggggagcttatatctttaagttgtctttatgtctctctgtttttcctttttaagtactctgtcttcttctgttaaggctgctatcacaaattatcataatctaagtggcttatgaacaacagaaatttatttcttacagttctggaggctgagaagtctaagatcaaggtactggcagatctgtgtctggtgagggctgcttcctggttcatagattctgtcttttcactgtatcctcacgtaatggaaggagcaaagaaaccttcgggttctcttttatgagggcggtagtcccatgcttaaaggctctgcccacatgacctaatcacctcccaaaggtcccatctcctaataccatcaccttggaagttagggtttaacataggaattttagagggacataaatagcacactccaaatacgtttgttgtatctactttgcctgtcttctgtatccgtcatctagtctctcattcttttcaagtctttattttcattttattttgttctcctttttttaattagcctttatgttccttattctattttctgtagcttttttttatcatttctgtgatttcacgctattatttcttgagctctgacaggttatatttgagcatttcctcttgacttcctgtttcttcttcatgatcttttttttttttttttttttttttttttttgatggagtctcactctgacacccaggctggagtacagtggtgcattctcagcagctcactgcaacctctgcctcccaggttcaagcgattctcctgcctcagcctcccaagtagctgggactataggcacgtgccaccacatccggctaattttttgtatttttagtagagaaggggtttcaccatgttagccatgatggtctcgatctcctgaccttgtaatccacctgcctcggcctcccaaagtgctgggattacaggtgtgagccactgcgcccagcccatgatctttcttttaaaggcagttgcttcatttattttacaaaactaatgacaaaaattttggttagacttttcattctgtcattgaagaaattcttgtgctctttgtctgttggtaagtgttactgctcttttttttcttatagtaaccgcatatcagtgttgttccatctcctttgctaatgctcaatactgaatgaattgggtcttcatgccttaggtatattagcagaggtgtttgtgaggtgggaagatctaggcagtcttctaaacttcacatctgaaaggtgttctcattaggtggttccacagagacagtgtacttgctgctaatatggccccttcttcaatctgtctgtctattatgaatcaatcaatcaatcaatcaatcagtcatctctctgtccatccatccacccatccatccatccatccatccatccatccatccatccatccttctttcttttctgcctctctagtctaaactgtatttaggaggcttcagcagccagccctactcactgccatactccttctaatttttttttttttttttttttttttgagacggagtctcgctttgtcgcccaggatggagtgcagtggtgggatctccactcactgcaggctccacctcccgggttcacgccattctcctgcctcagcctcccgagtagctgggactacaggcgcccaccaccaagcccggctaattttttgtatttttagtgtagacggggtttcactgtgttagtcaggatggtctcgatctcctgacctcgtgatccgccggcctcggcctcccaaagtgctgggattacaggtatgagccaccacgcctggccactccttctaatttttaacacatggtgaggtgttgcatattggtatattctactgttattgtaacttcttttccatggtggtgtatttttgttggtattttctgagaactgttaatggtaagctacttaacctcactcttcacttcattttctccttaatttatttccttttgcttctatcagacctttgccctattgacaggatagttgagtataccaaaaatacaattttagcattgcagggtgccacacatgttgagaaaatatttttgccagtgtctttggaaatttgcccttgaagaaccaactattctctgtttctttttttttttttttttttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggcctttctctgtttctttataatgatttttctgtacaatatcagttgcctttgggagactatgtatgcttggaagtgtgaacattatatctgttctaacttttatgattaaggagtttatttttttcctcatttttttcttttctttgttgcttttgtgtaatacccagcaagtggaaggttatttattctgatgccttgtttgtactgtaatttgaaaactgacattttgggataattttatttattttattaagattttttttgtattggtggtcatgtatgtagtttaaaatgaagtgtggatttttaggctataaaattagccagggtttagaatggtaaggtggataaagcacatttactttttttcctccatttttccttttgaatcctgatgagtattatctagttttcatttttggtaagttctccacattcatggactgctttgttactattctgaccataaaatgcttgaatttagagttctatgtgagaaaagtgatccttgttgtgctgttatgactaagcatattgtataccacagttaggaaataaaaagcactttgcttcctgagataaatcatctatatgcatctatccatgtatctatcaattcatctatctatctgtctatcaccttatctagtactattccctcaaattaaggaaggcttgagctctttcttataagttgctaactctctcattgaaataattcattccctgaattttgcaaaactgacatccataaatttgtgatgacccttgaagatatgattaaaaaatgaagaaactgttctaccatgaataggctaattgtaactttagtagccttgtgatttttttttctctaaatacccgctgtgtccatttgtcaaagatccttgcaaatatttaaattttgcatataaaaaatacctttcaaagaatatttttatgtctgcatttttcttttaccagtgacatttcactgatcatagaaatgaaacccagagttattgctatatttatgaaaggatgaatgtataattgattaaggagatctatttaatataaagcttataattagggtcatgataaagtcttgaattgtaaatatatgttgtatttattgaatagaatgcaattagagaatacaaacctataaaatatgtaatattagaggtggaaacaagacaaagtttctttgacaaaaaggtgcatgtacatagatttaggtcagagattgactaatgcttaaaaataaagaaaaaatgaatcaatttaattgagataaatgatccatgattaggataagagaaagtctagctattcaattcagagttcacttgaatgcatgggctgctgtcaagtttttaataaaagtacagagcagcttcctaacagaggtatgaataataagtttatatgtctctgaaacaatgttaatataattgaatcaaagaaataattaaatgtataatagtcttctatttaaatttgttcttaacagtgcaatttcttatttaaattctgtattatgaatttaattatttttgtcaagattttaaaaaatcattattataaccagttggcaccataattacttttagggaaggaactgtgttgggtgcggggagcaaaacttggtaagtcacttgggattaaaggtgtgggactttgaggatagagcctccgtaacaggataagttattctacatgagaaaatgggaagtgtttattttgaactactatatggattgggattggaggctgaaggcagtcttctaggtatcaaagggcagggaggttttacctgacatatgaattattgtttcatgtaaatatagttgaaagtcatatatatttagaattttaaatacatagtttcaagacagtgcttttaattttttaagaaaatatgtgtcatttattttttccaaagctagtggaagtttctttgtgtcctaatagcaattgcgtgaatgaaatcgacatgaataatacttccagttagattttcataaactgacagatagtttcataaatacccaatatgtaatgatagtcagagggagaagctatattaagtgtgtatttcaggagagattgtcctctggagcatatactagcatcaggcagctgctttatggaaccacccaccaattcccttgggttgttgttattattgtttgttttttgtattttgtttagtttctagggaacataattttctttgtgtttctttttgcatgatgctgaccaagtcatgttcataaatcacatatgttgatatctacagtgctttcattggccttccaactcgagcatggcaaaatatgcttattttccttcagaagcgcatctttgtgttaactaggcattaacaatatgtgcttaatagcaattatcttatttctaaggatctcagagttggtttggcacattgcctcagtgctcttcaaacattatcagagaaggacaacataaacaataagatttacactgtaaaattagcctccacttacaaattcttttatcagccaatccttatcttaataacatatattaccttttattaaagtaaatatgtccctcagctctagcttttttctctgtatttttatgtacatttatggagttttactgaaatatttagaagactactgtctaaatacggttctaatttttaaaatgcataatctttagggtaaagtcttggagagtggcaagtttaatcaaacagtaacgctatcagagataaagatcataactcgcattaaattctataatttaaaataaactatgtctggtatgtattcagaaaatgtcagagctagaacatttagttcagtctctatttcatgggttaaagaaaagaaagcttagaacagtgaaaatacttcctcaaggtaatacttacagttcatggctgaagtggtaataaaagtcacaaccaactttttcctctctgctttcttttctttctgttctgtcattttaagtttcttaaaggaaaagcttagagaaaattaagtattgatgatagagcagatacaggattttcaccgggtgcagtggcttacgcctgtaatcctagcacactgggaggctgaggcaggtggatcacttgaggtcaggagtttgagacaagcctggccaatatggtgaaaccctgtgtctactaaaaaaacaaaaatttgctgagtgtgatggtgcacacctgtaatccctgctactcgggaggctgagccaggagaatcacttgaacccaggaggtggtggctgcagtgagccaagatggcactactgcactccagcctgggcgacagaatgagactccatctcgacattaaaaaaaaaaaaaaaaagaaaaacaaaaaaaggattgtgttaacatgggggcctgggtgagaagagaaaatttatttataggaggacatgtaggaagggcactgaagattactgtttaccattttgaattgtccctgctccagtcttacaaagtgggacatgcattgtgtttcttgggcatactcacttccctaagaataagctgtatcatccaatgctatttgcacagaactcacggctttatatttactgtcctaaaataagtgatttacaatcttttaaactttaaaacagtaaatttgattttcagcgatgcctttttttttgtcattttaaggccccctccaaagtgttgtaacctagctgaatgaaaaataagtggcatttttgttgttattgttggtgatgatacttttcatggcaatctttgagatacctaggaatattccaagtttttgaaaaatcatggttgggaattaccactctggaaacagattgccatggttactgtgttaatgctgtgattaatgcgtcttttagtcttgtatgtgtgtgtagatgtagacataattctatattctagtttggttaacatgtttgatctttttctatcagtcagagacataaaaatgtcttgactctcttaaaaacaagactgttcccattttttaacctaatggatatttgttgctgaggatcatttttttgtaaggagtgaaatacccagaaaactaaagtggtctagaagataactgctagttctacatttttttttttgtctgaagttgtgtttgaatttacttcctttcatcacttagtattaaaagaacagtgtgtcaattatagataagaattctacatcccctgtctttccctaagtacctgcttcgaaaaatgggtgcaactagactcagtagctagatgtggtatgtggaatgtggattcgttcgtatcaggcatgcttcttataggaatcctttaatgcactcagtcacccagagcagtcaaaggcctaagctgcttcatactttatagcagggcacagtcacttccataaatactgtgcactcccaagtaaatccagaatgtttgcaacaggatttgtgtaccatccccaattctctgttttcttcaataaagtctttgtacacaattgtttgattgtttttatctcttgatactcacaaataatgccactggagaaataaacctaagacatatccaactggatcactttatatacagagatataacatttcaacaacagaagcctttcttgttgaggggatgcacatttggaatactctcaaatgattattcgaaatcaagaaaaagagccaatgagaaacagcaaaacacaaatatctctaataaggaaaaatatttctgcaatgagatttttcttagatatatatgtgatgattaagagcatttgtttatattgtaggttcttgtcctaaacttacaatagtaagtgtagacaacactaattgttatggtaaaaggtgctacatgtgtgtatgtatgtatatgtgtatgtatatgtatacatatattatttggatattccagtcagtggtacttactgcccttggttaatgcataattgtcttgagaaaatgattatatgtatcagtgtgatctggctaaaacaactctctccaactgatcacctgattttgtttcatttccccgggtaatctggtaggtggccatttcttttctttctagtctatgttccctcctaaagataaaacttggtcaaacatctatttatggtaacctgtctttaagatagtttcaggcataccttcttcctttaatctcatttggttgatatgttagatcctttcctatcagccagagaaataaaaatgtcttcagtgtcttaaacaaaattgtttacattctttaattaaatggtcattttaaggagagaaatgctcagaaaattaaactgagtatagaaggtaactgctaattctacatttcttttctgaaattgtgtcttcatttgttttttaaaaatcatttagaagctgtgtagcccacagagaagttctcaagtttgtggaaaagaaataattaagtcccgaagttaggggtagaagagaatggagctttgttggtcaattctgacatcttagaacacctcagtaatgtggttctttgaaagcatcaaatcgctgcggttactttagaaaggtcatttttagaatgcttatactacttttcccccattttgaaggtcaactggggtttattttaagttagtattgatgtaaaagatggcacaccctcttctggggcataaatgcttgaggatgagccatagtcatgcatgacatgtgtcaagataagaaatggaaatttatctgcagagactaccatatgatgtatgtgtaaattttcagtccctgggattatgatttttttttttagtgaagacaaatgttttttgttagttagatcctgatttttggcatgatttagtaggagaaagaaggttttagtttagacatagcttttcttacatcttgtgtaaaattgtcagttatagggagggtaaacactgcactctggaaaggccttctggaatgtccttatttctgtgtgagtgtgatggaaaaaaataacttttaaaaaaatacatgtttaatgaaagatatttccaggttattccttctggattttaatttaacgcttgtttgtatctctatgatagcatgtatgaaaatgtattttaatgatttaattatctccccatattagatgatcttgctatctttatcatatgccctgtttatttttctattcctggtgataggtggagtgactgatacattgcaggtacataatatacatttttgagtagatatgtgtatgattaattgacattttgcaagcctttttttccaacttttaagttctggggtacatgtgcaggatgtgcaggtttgttacatacgtaaacatgtgtcacggtagattgctgcacagatcatcccatcacctaggtgttaagcccagcatccattagctattcttcctgatgctctccctcccacccctcaacagtgtgtgttgttttgacagaccccagtatgtgttgttcccaccacgtgtccatgtgttctcatcattcatctcccacttatgagtgagaacatgcaatatttggttttctgttcctgcattaggcaaaccgtttttttgtttgtttgtttgtttttgtttttgtttttaaagaaaaaagaaagacatgctatgaaatggccttggacctaattcaagaaacgaaagaaagtcagagatcaaggaagaaaggaacaatgcagagtttatggaagttagatgttaagatgacagctgagtatgcttcttttctcctcacccttgtttagccaggtgcttacttgacaatttgtaaattaaattattccttgaacaatattttgcacaggagtaaaggaatgcttcatggataaacagaggcaatacctggagctaatctttgtggataaatgtgtttattttgattcctgaagctgggatgcagaactgatagagggaagccagggggttttctctgctccaccaaataaatcacatatgactagaaattgcaaccagacagcaatctgtgaagcaagtgataggagctccaccgtctggtgcctgctgtggatgtctggcacccattggtaccagatttggtgtaagtggggcttctgtttaggaaactttgccaatttttttttcttgaaaagtggattttggctttgtttctgcattcttatatgggaataaaaaaatctcataattgcaaatgtgtttattatgccccaaacattagatctaggctattctttccataggatattgtaatcctgtgtgggtacatttgctgctgcatttgacacagtaaagttgtattaatgtttttcattctgctatcttttagaactaagataggcataattcctaatttatctgtgctcccccttatgcatacatttaggtagtcaaaccttgagagtttctatagaatatttttaaaacttacctttggtctgtcttatccttggaaatgttttcacgtttgagagcatcacctcctatcagatcattctgttccttgaccctctccctctgacaaatttcacatctttcttcgcaggaaaaaagaaactaaggctatatcatggctttcttcactcctcttcattctgatatgaacatttgaagcaagcattgatttttttcttccttcttcttacttttgccagaacccatgatgctgtttattctggtggggtgtgtgtgaaacgcatgttgcagttccatctctcttgaccttttctttgtttgctatgtatattgcatctcctcagttgtccaggttatcgcaagaaattgtgctggatttctactcgctcaccttctatttcttactaaatattccttgttgtatcataatccctctcaccagaattcctcctgtgtgaactcatagattacaatctacattgctgcaagagactaccaaattttccatctttctcaggtttctgcaccttcactcactcttatatctttccaaactttcctttccatctttcttaatgtcaaacctgattagtcattctcctgcttaaaatcttccaccgagttctcagggctttcaggttgaagttcaagctcattagtgtgacatacaaggctcttaggacctggtggtctcagcccctggctacttccctaaaacactgcccactcagaccagatctaactagttttagttccctatatcatggtatactactgcgattttccatgtgcgcttactttactcccaggtctctctatcctcttcctcttcatgtaactaatttcttcctggctctttgacactgggcatcagtgtcatgtccccagtgtctaatgtgatgtctttcatctgttctcttataggcttggatgcatctccttcctgtcatcttactagtattattgttcactgtccttccacggtggcacagagtccccagggtatatcatagtattgtttgcaaaggtctactaagagtaaatgagtaaatgaatctaataattttttattgctttaagtgctctgtattttaattcactgcctatcaagccttgctctctttgaattatatttatgtctaaatgttcatgatagcatcagattgaattaattgtagccttatatattgactctcaaacatgaccaagactgttattgttgactctatattcagacaaataaccagacacatagagtaaaagagttaacccatagtctgtatgacctaatgaaaagagcttagacaagaaccaaggagcaacagtctcaaatgtcagatgcctttgccatattactcccatttctttttttatagttaaaaatgttaaattttaaaggttaatgtgatgctgctaagccctctgtagggtgattgatcagcttaaatgtaaactattttggtgaccatgatatataaagtcatagtgttgaaaaaattcaacaatagttagaatcattttaagaaaacaacattgatatatgaaaatattcacaattgagaaatcttatattgatgaacttagagattatacattttggtcttgaggcagaactcatcttagtaaaactgcttaagaacttaatcttgatcttataaaataaataaagatggtattttgtattttaaactattgagtatgatttcttgctgggatctatcactatgaaaagtgattattggtttagagtggtgttctcgttattttgggttttgaaggagcacagttcatcctgttggtctgtgttaaccaggggtaggtaaagaggacagaggacacctagcaatggctcaggtattatcagtgagcagggtgagaaaatccttgtgtaccaagaggaattttgtcatggatttgcagaactttcaaaaacaagaaacattatttccacttttcgtgtgattcctctcactttttaacctcttttctcttttccttcttttcgagatggagtcttattatgttgtccaggctggagtatattggctattcacaggcatgatcattacacgctacagcctctgaactcctggctcaagtcatcttcccatctcagtcttgagtaactgggactatagatgtgtgctgtggtgcctggcagagcctcttctttaactgtaatagacctgcttatcatgcatgaaatgatctacaaacacaaagtaccctatcatcattatctctttggagtactatgtcctttaaatgtattttcttactgtaactaactacctaggctggaggtcctatctctaatttagaaatgaagaaagtgagacctacttggattgagtgagcattcgaagtacattcagaagtggaaattatttttaaaagttaaatggcttctagaggtcatgtagtctcttttgtcatatagtggagaaaacagagaagttcaagatttccccaaacgttcttagttactggcaaacaggagctaaatgtcattcttcctggattttagtcagtatttgcttggtcacttttcttagtagagctttttcttctccttgcattcataaacacttaataaaagtgaattgataatgatcatatatattatataattaggtaatattagccgggcatggtggttcatgactgtcataccagtttcatatattagaagaaaagtacaaattgtgtagctactcaagtgcaaaatgtagagagaaaacctagagaagacatgaaactctctccttgactaatatcttcaggctggggatactatgaacaatggtgtgttcagaaagaatgaacaaaattgctgtagtaactcaatttcagaagagtttgaccctgtcagaatcatctactgtatttgcatgagaaatatgaaaggagtccaagggaaagatgatgtgttcagtgttcttttccactgcattggagcacctgaggagctgaagagagaaacttgtgtttcttctttgagtggcaagtgtgttagttaatatcatcaggcagaacatgctttccaagagtttagtttgctccttcacaaactaaaatactctgaagtgcctgattttatgcaaattacttttggttgttgtattgagaaatgaaaggatgccaacatttttttttataaaccaaatactaattagcattaccaaatttatctgttgagatacaccacttatttgtaagagaagctctttgacaaaatgaaagaatatgaataaattcttcacactggctatatgagaccttggaatgtcattttcttttttttctgtagaatttgtgtaataccctccactttgttggactgaatgagatgcatacaaaacaaccttgtaaattacagcattctaggtcagaggctagaaatattttctgtaaaaggcaagagagaaatattttatgcttttgtgaaccataggtctctgttgcatctactcaactctgccattgtagtgtgaaagcatccatagatagtacataaacaaatgagggctgctctgttccaataaaactttatttatagatacagaaatttgaatttcatgtaatcttcacctattgtgaaatgttatttttctcttgatttttgtaaccatttcaaaatataaaaaatgactcttagcccacaggctgtataaaaacatgtagatttggtccaaggtctgcaattcactagcctttctccaggtgactgcctcactatgaaacagttccaagtataaagggattaggatatgatgctgatgttgggattgcatttactgagctatctaggtgattgactccaggctctctctctgatactgagaacatgccttggcatatgttcccagctaacgtttgagaaaactcattttcggaggaataattttctgttgtttgttgctgggagttgggcagaatatctcaggtagtggaaggaggatactgcaccacacaactcatagaactgaattgatacagatagatgtcagcatttctgtgcaaaaacaaatgtttcaaagttttgaggtctcagcacttttccaggcacagcattctggatcttggcacacagatgactctcagtttgaatagaaaatgctcacctttctttttgctagttttattccagagccaatctctttataataaagaaagcaactgaaaatggaaaactcactgagcttaaagcagccaaaggaaaaatatgtgctcattttaagttttttcttttgcaactcttggccaaataggtttatttttaaatacttttcacaatttacaaatgtttgccttaggactttgtgtaatggcattggttttatacagctattacagttagggtgaagagattttcttcacagagatggttttggaaaatgtctcatcacacaagtggtaagtgtagtcgctgtaattgtattgaagaaaagaaatgactaatgggaatcacaaaattgtgaaattgatgatcatttctgtttttattgcctttattttaaacataatagtgacaaagtctgaaacaatatttggagattgctacatatttaaatatttaatgcaacaagcatcccactttattataggagatagaacatcgactgtgcctaacctaaattacttttccagggggttttagtggattattttcctattaaaaaaaggggaaaaaagaaaagaacagtctggtacaaagtataggtgacggcttcagctttgtaattacctattaattgatatctgtatataagtataacaaataaagttttaaatactgaaaatgagatgagagatactaaaggaaacaatttcctgagaagtattaggttagactgtacaaatgtaaaaaacatgtcaacaacctggcagcaagtagtcttgagaccttgaagttcaatgagagcagatgaattgtctgctcttttaatagtaataaaaactatctaaggcaaaattttggcatgtaacttaagaaacttaaaaagtttctcatgctttaagacactttgattttattagatctagaatgaggtctgggaatgtatatttttataaagctccactggtgacctgggtcaagttttgcaatacagaatttgaggcagataatattatgtaggaggtaggagatttattggggagtgctagaagtaccaataccagtgggggagtgaaaaaagcatgtctgtagagcagaagaagctggactgcagagcagttgcagtagaatcccatctgatcctaaggagccctggagctggcattccaggccctggagagttgtcctggaatgaggcaaggaggagggtttgtacccttgcattcatcagtcatgggatacaggatgccccagggagtgggtgaaaacttgagggagatagctctttccaacagagggtagtgtccagagaaggtctggttatgaggtgtcagaagccaacacttgcaatcattggacgaatttcagtcctgaagttgtttctaggcagcacaccagtgtgtccattacaacaggctattcttatgattgaaaaacgattgtctaaggggttgttgggaagaagtacttggactggagggtaggcaaggagtatttatctgtttcttaaacatgtacggagtgcctactatgtataggtactagagacataaacatgaagagataagttccctacatttaaggagcttaccatctagtgggactcagatatgtaaataaataattaaaacataattgtcaaaacaggagggtatgtggtatgtgcatgtttccaggttttaaaaaagctttacttcacaaacaaaaatgttctgttcattctgcttattttgatttgatagattacagctcgcagagctaatattctcttaatgtaagtttcttccccttcacagatgtttttccatctcctctaatttctcatcgttctgtgatgagacaaccagagtctttaaaaaataaatactttgcttttctatgattaaatggtttgatgaaaattaagccataagcataaagtgctaaatagaataaacccctggcacataaaatgggtaggtcctgatatcctctttcaattcttcaaatgtataggtagatactgataccctgtctcaactgtagtcaattacactatatattttcctctataaaatgtatcactggccacgttcagtagccctccattactgaatggggcaattattcaagaatgccccagtgaatgcctgaaactgcacctggtaccaagtcctacatatattgtcttttttttatatgtacatacctatgataaagtttaatttataaattaggcacagtaggagattaacagcaataacaaatacaatagtaaaacaattgtaacagtataccaacatcactgctcttgtacttcgaggccatcatgaaggaaaataaaggtgatttgtacaagagcactaggatattgtgataacgcagacatctcctagacaggatctactggacaaagggatgattcacgtcccgggtaggagggggcaggacagagcgggacagtgggagacttcatcttgccacatagaatagtggataatttaaaaattaggaattgtttacttctgaaattttccacataatagtttcaaaccaagggtaactgaaaccatgagaagtgaaactgcagatatgggaagactcctatagaaaatatttgggctgggcatggtggctcatgcctgtaatcccagcactttgggaggctgaggtgggtggatcatctgaggtcaggagtttgagaccagcctggccaacatggtgaaaccccgtctctactaaaaatacaaaaattggctgggtgtggtggtgcaaacctgtagtcccagctatttgggaagctgaggcaggataatcgcttgaaccccggaggcagaggttgcagtgagctgagatctcgcaagtaattggttatttactacataaaaatgttacgtagtattcatatttatgtttgattgcatcacttttttttaaacttttggctcaaatattggtagttttcaaggaacttttctgcagcattatatgaatatgatgacaagtagaaaaaccaaaagggtgcatcaatgtatgaaagctggtgtgttaaattgttatcatcattaacaattcactgctgcatgctaaattcatagctcacacaattcaatttatgccttataaaattacaaactattacaagtcatggactttaaggttgctcaccaagttatcaagaaggtcaaaggtaaatgcaactgtactattctatggtaatttttcacaaatcccattgattcttgtttatgatactatttcataaaactcagggtcatataataatgttctgtttcaaaacatgttggtgtatttcaaggtctcagaaaaggtattgaaattttttggtgagccaaagagaacaggaaagatgatgttttgtctgtaaattccatgttgactctgagttagaagagactctaagggtcatctggttctgggctgttagttttgaggtaataacgttttcatttacaaaaagaacattggtaaagtaataaaagcttatttttgtatatatacttatttacgcacagattatacatgggaaaaatggtgcccaggcagtttgctttcagtgatatatgttaggtgaaggtcaggaataatattgacataagtaaatattggaatagaaggcaagacttggaggtgggatttaaacaaataaacaaagttttttttttttttcctttttatgctactttgcaggaaggtcatgtcaaaattaaaatagattctgctttctaccttggcaagtaacatgtattatgcccactcacatgtaggtcttatctgctttggcaaatacttacagaagaaagtgtaatttggaaagagaagaacataatgatattagacaaaatagggtcacaaaaatttacaattggaaaatgatttgtaagttaataaaattacctagagccagattctactgtctaaatataccactgaatgtaaacaagcttttgctgagctagtatagacaggtttgaaaaacttggttttctccagtactcactcttatcaaggaggaaaaaggcccagaaaaaaaattctgaagagtatttttgtatcatttacttatgccccatctttttctcaaatatatttaagacagtttatcagaatacatactatgtaagaaaataacataaataaggaaatcagggcaaacagaatgtaaggttttgaaaatgaaaaaggatctggggaatctgaggataaagttaacacaaaaaatgcttgaggatctgttcatctgctgaatgacggttacaaatctgtaaatattctgatagccaactctaagagaaaaacacagttatttcaatgtttatagttatcctggaggagcccaattctttctctaagtgggaccagagaaaaatttcccctttgtcctaagaaagaattcctacggagtatagggtaatcaagaactcatgaagctgtgtgtcctgtaatgccccttaagtagttagatgattgcaggccaagagcaatacagtcaaactgattttaccaggaagaaaaagcagtcagtccaaaaacaacattcttgtggtttgattaatccaaaattggttagattcaggaatggaaatctgcatagactttaggcaaacctcaataattatttctgtaaccaagattctgataattgttgaggaagtagtgaattcaagcttatgctctctgtacttcctgacaaatccttggagtgcatcactgctatgttgttagtgcgtgtggacccatatgcctttgatatttgccaggctggggatataaatgacatataaagatgttctaatgagggctactcactctcttttctctctcacagacacattcactcatgcccatgtatatacagataatcatatagacatatatacacacacataactattgaataatttgttgtttaaaaaatatgtttcaaattaatggggaaagatagattggggaacagatgggcgtcagacaatttgctatcaatttggctagaaatcaagttagattcctatcttacaagatatgcaaaacatagaaggattataaagtcaaattaaaaaacaaagtattagaagaatatatggagcatttttatactcttgcagtagggaaagatgctcagagcaaacatgaaatccagatcccataaaataaaaatacgaagtacttaggcaaaaaccaagaagaaataacaaactttggtaagacacaaatgatagtaaatgtataaaagtcaatataagtaaaattaaaagagaagtgataaacttggaacatgtattctaaacatacaacatgaagaagcttagtatctatgatttttaaagaatgtcaagatattaatatacaggaaaaacagcagaatagaaaaatgagtaaagaacatagtttttttctttttgaattaattgaatttgaaacagcggtttttctccttcgaggagtaggacttttcacaaagcttcagtggattgttctaaatactggaaatgatatggagaagcacgtctcatctttctggaaagcgatttggcaatgtatatcaaaccttaacattacaaatgagcagacccaacaaatgttcatataaaactcacacctaaaaatataccagacatgaaggcaaagctatatatacaaagggtgtttacagaaatattattcttatgtcaagtgtggaaaatactaaccgaagtccacatgtccaactgaagaggaattagggtttaatgatttaagaagatatcatgaaactattaaaattatgtttaatgttaattatataggaaaatccttgaggtaaagttttaaaagtaggatacaaaattatgtcatacacacacacacacacacacacacacacattttacaaaaaccaaaatatatgtatgatatgtattgttttacacatggagagatataagtatacacattataaatacaaattaatacttttggtcatacaggatgtctctgttttttgaaatacatttttcaatagttttgacatttttagccataagtatatatcaatagtgttatttgaaaaatatttaaacagaacataactcagttaatatatatgtactaaataaatttataatttttaagggcagaaaagcataaatatttcaggaaattctgaactaaaacacagttgaaaacttctaagactctatatcaatatgcaattgcaatgttaaataaaataaagatgttagcaaatagcacaatagtagttggcatattggaactagaatttcatcacgttatttgcaagacatctaatatgagtcatttgacccaatattttccttgtcttactctgggatgatgatacctctgtcatggggttgctgtgaagagtcagtaagatgtaatcaaccagcgaatgttaggtgctcagtacattttaattcttcatcctctttctctttttcctctcagcacagataccagatgtaaaaatgttatttatttttttcctagcactagtaaggagttgaaagtttttttccataaaaacagtgcccagttcttggtgatgacagcagggagacctttctcactcctcttcagggtgaaggtcagtgggttcgttccagttcattgactggttgttcacagctgacgttatcacgattagacaatgctttgccttaccaattatttaacgtaactgtgcttctgtctttgctcataaaaactctggtttggatacttcactcattgaaagcagcagaggcaaatcatcaggtatatatacagcttcaatgcctaagatattgggctacttttgctagttagcctgtggtccagtagccgcccccacaccccaccatctatttttggaacgtatacaaatggagaaagatacattaggttcctccattttaatctagttatttttttaaaaaaattataagtatgaattttaggctgtaagtgtaattttgttagatggatagattgtgtagcattaaagtcaggacttttagggtagttaccatccaaataacatatattggccagagacagtgtctcctgcctagaatcccagcactttgggaagttgaggcaggtagattacttgaggtcaggagttcaaaaccagcctggctggtcaacatggtgaaactccatctctactaaaaatacaaaaattagccgggcatggtgatgcgcccctgtaatctcagctactcaggaggctgaggcaggagaattgcttgaacccaggaggcagaggttgcagtgagccgtgattgcaccaggccactgcactcaagcctgggtgtaagagtgagactctgtctcaaaaaacaaaaaacaagtatattgtgcccattaaataatttctcattatttattcctctcctatgtccccacccttctgagtttctattgtctatctttttatactctgtgtccatgtgtatgcattatttagctcccacttgtaaatgagaacatgcagcatttatgtttctgtgactgacttgtttcaattaagacaatggcctccagtttcatccatgttgctgcaaaagacatgactttattctgtttttttttttttatggctgaatagcattccattgtgtacctattacatttttttttcccagtcatgcactgatggacacttaggttgattccatattctttgctgttgtgagtagtgctgtgttaagtatacaggtgcaggtatctttttgatataaagatttctcttcctttgggaaaacacccagtagtgagagtgcaggatcaaatggtagttctttaaactctctaagaatctttacaaaatcctgccactgtaggtataaaacaatatgtggtctcacttagaataaaatggagacattttaagaatgtgttgtttgaatcctggccatgttctttcccagaggctacagtttggtgtagttcactggatgtgcctgtggacactgaacttgactggctattggatttctgactcctggaagattttgaggagttgcagctcttgttctctttcatctcccacccatctccagaaaagtccaggttacacctgtggaagggttaccagccagaggacagagtgtgaaggcttgcctggtaatggcaaacccagttgccatccacatgtcatactttgcaccatgtccctgatttgtatgggttctgtacatgtcacagtttctaagagtgaacctctctgcccccccgcccacatgactctgctgtcagctttccaaacaatgagaggacagctcctttgaaagatgtaagttttccattccgaaagatataaatttcctggtcctgcagaggctagaaatacctcttgtttgggtcactggactcgggctaggtgatctgcaagatcttacacaatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctacaaaaaattaaaaaaaagccaggcatggtggcgcgtacctatagccctagctgcctggaaggctgaggcaggaagatcgcttgagcccaggagttcaaggctgtagtggaccatgatcatgccactgcactccagcctgggtgacagagtaagaccttttcttacaaaaataaagaaatagagtacagattgtaactggcaacagtgagtctgtctcctccctttcctcgggcatcagagtcaaaagaatgacaataacatttgctataattattttaagtttttttaaatgatatggcccacatatagaaaataattatcatgttgtcttctaaaggatttgattactagaattagataactgatttctttctttcaaaaagtggaagcttttttttgtttgtttgtttttggttaactgcattttaaattttaggaacaagtagattcttcttcagtcttaaacttcagcacctgctaaaaataaggattacgtattaaacattatattttcccccagttttctctggatgttactgcaaaaatttactcactctcatttggatcacaggggctgataaatgtgtgtgtttccagatgctgcaccaggactgaacctgtggagtaggaaatgattctaccttagatacacataccctcctctcctgtttttttattctaagtctccctagcctcttaggtttttgtttgtattaccctccctctttcctgcttccagccatccctattatgactctaagggtcccatgaaagattaggtcatctgtgatgctgtcagaggcctggagaagtcctccacctatgtgtgcgtcatggacacctggacacaggctaaaagcttcttgagcaacttggtaatggccttctgaaaaaaaatgcgctcagccaatgtattactaattctactgggggaatttccaagtcaatttctggggactgagagtggtacagaaggatgagggtgtttaggtacactttaaattcacagtgtatgatgtgccctgaccacccccatcctccacacacccactacttactcctaaaacaattttttctaagccaaaagtggtttatgacaaattgtatgtttgcagatttggagtctaaagaggagtagatttatttaagggccatatttagtgttagtaaaagctacacttactatgctaattgcaacttaaattagagctttacctttatcaccaaaaaaaaccccactgtcttcccttgatgttaaattgtaggaatttaaagtaatttaaatttctattttttctacatttccgctttttgtatctgtacaatatgattatacatgtgaatggttaacaaaaactgtatactttagtctttaagtggaacctcagtgcaatattttgtaggcattaaaaatgataagcactttcatcagactattagttttcattttgttgactttgtttgtttagttctttgtggtataccctgtagttataatgaaatgatgtaaatctatatatttgccaacacatagatgtatttctttttaacttaactttttagcattatgcaggaactgctgctcactcgctaattatcccacagcctcgcaagatggcatctcctgttttctagcagatcaggatcaaaactttggaatcatttctctttctcttacacctcatatcccatccataagaaattctctgcatgtatctagaacttggcacttcttaccactttaactgctaccatccgtcatcttttgcctggattattaaaataacctcacatctgtccttttcttgccattttatcctttattcattagccagaatgagccttctaagactgtagtcaaaagtcatacagctcctttactcaaaccctccatgaacttctgacctcattcagtgtaaattcccaaggtccttaccatgaccttcaatgccctttatcatctggtctattaatgccacctgacctctttttctaccaccgccctcaggtcactctgcttcagacataggggcatcactgatgtttcagaagcactgcagaacccttgcactaactgcttccagtgctaagaatgagcttactttgtataagcatggcttaattccttactttctttggtttctgtccacatgccactttctcagtgaggccttcgctgacttccctgcatgagctagaatccactctgcacctggcagtctggacattcttaccttggcttatcctctattatcctagagatgtctgtcttcatccccaacacctagaacagtgacggacacatgatagctacctcatgattatatttgaatgaataaatctttaattatccataattgggtagtagacccaatcttgcacaggcagccaagaaacaaaaccaagaaaaaaaaacttagtttctatgtagacctgccactaactagacatacttccttttgcaggtgtttaacatctctgagtctcaaatgtctcaagtattaaaatacaatagattgaactagacaatttcaaaagttctgcttgctctaataaaatactttacacgaagtaaacacaattccactgatgtttgttcaatattttctatggcaaggccattcctcattatatataactcaagtagataagtagcagttgttatttgtcatatgtatgtatgtacgtacacacacatgcacacacaattcaccctctcccacaatatcactgtgttacacaatcctcagtcctattacctctgagacccattgtaaataaaatgtaaaatctttagagcatgttggacaaatacatggttttggttctgcctctttccagtcgcagacatcactgtgagattatagaactctttccatctaggccaagactgggtctaagaattcttctcagacttctaggaaagatatcaaacttattagagttgaaactagagatgtaacatagattttattccaggttttgggtatctgagagcctagaagtggtgtgagataaagaatttgatacaccttctccagtctttttgcttggttttccttcaattcatccttccaaactcattgtagataccacttctcctaggatttttccccaaatccaagactgtgttatgtggcccttgttatctgattacctagggccctggtctcaattacagaattattatgttgtaatttctttttaattttaacttgactgcatcatctacctgactgtgttctctagaggttcagaccaagaattgcgttttgaagactgagagctgggcctgacacttactagggacacaataaatgttgacttattgaacagataaatgaatgaatgaatgatgcccaggatagaatatttggtactgctgtcctgtctagcacatttctccaaggtaaaattatctcccacatatgacaaaaatctacctttctcttggttaaatcccttagtaagctgcctatcagagaatttgagggttaactcattcttttagaataatgtaaataacttggatgggagcaggctgtatgctttaggtcaattagaccaccttctcatgcctgagggaaattgtcccttaaggtctgttctatggcacctagtcccctaagatttgacaagaaagcgttccacagttcaatatatttggaaaacattgctcgctggcctttccccttgaaatctggccatggacattagcttattagagattctgagtcatctagtaaagaattctgtttaatttttttatagctagaatttttcatttcttttgaacttaaggataatattcaacattatatatattaacattctactggactaatgctttaggaaacagagttttacacacatagaggccatttaatagctttaaataacagtgtagcagccatatggcagtgagcagattggatttggaaaggggtaaaaccagtagggaggatgttgcagaaatctagatggaagaggatgaggcctataaccaaagtcctcatagcggccacggagaaatgaaaacgtttatgcaagaaactgatctcgttactgaaaagtcttttgcaagagtaactaaggtggttagagaacaggaggttggtactgtagtgctttccctcttctgcctttcaaaggtaagagcttgacttcgtttttaagccagcaggggttcttacatagctgagtgtctatcactacttaatgcatgtataatgccctgctgtactgatattcatgataaaaatcaaggtatttacagtcaattataatttcttattctcaaagcatacattgattttcttaaactaggcttttctgaactgggtatgataatacacattattatcataccattattaggcctctctttccaggtctttcagtgaaatctgtgtgtgtgtatgtatgcatttcctaaggctgttggtgcaaagaaacacaaactgggtggcttaaaaacaacagaaaccaaaatcaaggtgttggcagggccatgctccctgtggggttctggcagatccttccttgcctctccctgttttctggccatgtctgtcaatccttggtgtttgctggcttgtagctgcaatgcttcagtctccacctctgtcattcgatggtgtctccctgtatgtctctgtctctctctgtgtacacattttcatctttttgtaagtacaccagccaaattggattaagggtctaacctactccattatgaattcatcttaactaattacatctgccacaaatttatttccaaataaggtcacattctgaggcaccgggggttaggactttaacacacctcctttgggggcccaattcaaccaataactacatctgtgtgtgtgtggtgtgcacgtatgtgtatgtgtttgtaagtgcacacgtaagatgcaccaacatagatgcaaagacgtttgtcttcccaaatttactagtagtatttctggctctactcccatgaaattacctttaccctttctctttgaaggatggacaaagccaggtctgataaagcgttagaatttgtcatggctggtcttcacgcggcaaaccaattatgtgaccacccaggccttttcatcatgcttggtacattcatggaatgttatctcacactggggttggtaatgcaatactaattctaaaaggctattctgattaatgtattcatcttggtttagcattttttatattgtttatttcagctctcctttcccttttgtgatctaaatatattttctttcaggttattttgctaagtggttccgagctaattttattacttttttgatggtaagggtctaggcagagtagcctttctgaaaggcaagctttaccgacttctccaggttcataaatattaataatgtgtaactacgactctgtgtgctaaaacattgttgtggagattgtacaaggaaggcattttatgatttcatggagacatggagtagcaagaaaatggagcaatgacatttggggggagcatgacatctaaatgttaatattgtgtactgcttactgagaatgagaatttctcttcttttgatgctcgtgttgtcagttgcacgagagtgttcttcaatttgtactttacttcttctagctattttttttctttataaaactgctagaaaagaagccagctagtattttgaataaaagagttgggattgtataaggcaatgtttttactcagctttcctcgaccttttgatgaaaattccagttcaaaataaaaagacacaggcactaccctctgagagagtctgtgtgaccaggctatcattcttaagaaacggattgaaacttcttagtacatctcataaaaaatttagttagctataaatgttttaggctgttgcagctgatatcatttgccttgtgggaaaaaaaaatgaggctgttttatgttaagtgttttgttttctcttctctctattctttttttatatgtattaggcaatgcaaagacttttactaccattgttatgatagtatttaaataagcagaccaaacccatgcatgggactgaagagtaaagtcaagaaatatttgagatgcctcttttaaattaaaggtatattcttcattgctaattttgagttcaattttttactgtatattaaaatgttaatttcaatttcatctatagcagatggtatcctgcttttattttctaaagggattcttcaagtaagccctcagttgtcttgcattatgagtaattagagaaataccttggttggtcctcagggcagagctaaaaatagagttcagtgatttttttctgtaattcttactatttttaaatagaagaaaatgataggcaagaaagaaaaggccatacttaaccaaaatgtccatgacttctttcattactaacaaaaaattgccaagcttgacagtttgcaaataactctcccttctccatgaaggtaacttggaattcgatgtgtgtgtatgtacctgtgtgagtgcatgtgtgtgtgtgtgagagagagagagagagagagggaccacaaagtctctgatgttaacaaatacaagaggaagagcagtagatgagggcagaggtgtggtaagcaattgatctggcaaaatcttgaaagttaagacaagaactctgggtgttactctgagatgggaagtgtttcgactcagcaatcccataatgggtatatattcaaaagaaaacaaatcgttttaccaaaaagatacatgcacttgcatgttcatcacagcactattcacagtagcaaagacatggaaatcagcctagggcccaccaacagtagactggataaagaaaatgtggtacatatgcaccatggaatactacatagccatacaaagaatgaaataatgccctttgcagcaacatggatgtagctggaggccattattctaagcaaattaacacaagaacagaaaaccaaatatcgcatgttctcacttacaagtgggagccaaacactggctattcatggacatatagatggcaacaagagactctggggacccttaggggcaggagggaacagggggagggttgaaaacctacctatgaagtatatgttcagtaccttggtgccaggatcatttgtaccccaaagctcagtatagtgcaatatacccaggtaccaaatctgcacatgtaccccctgaatctaaaataaaagttgaaagtaaataaatagataaataaatgcattaacttttttcatgaaaactaacaacaaaaaacctgagaagacaggccgcaaaaaaagaaatatggaatacatttaacctacaaagaaacaatatccagaatacataaggaacatctaaaagtcaatcgtagtaaataacataaaagcaaactgaaaaatacttcaaacgacattattcagaaaatgtatcctaatggccgataaacattaaaaggtgctgaacattcttaatcatgaaaatgaaaaatagaccatactgagatgatcatttatcatccagtattaacaaaaatctagaaattatgacaataagttttgggtaggatgagaagcaatactgctttggggtatacaattgctttggaaataatttggcattagctgtaaagtttgaagatagacctatttacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaactatagagaattttaggagaatgattaaaagagattcagaataatggtcacctgtggagggaaggagggggctatgattggagaaggtcatgctatctacaaatgtgttgttccatttctcagtctgatagtagaaagatatttgaacatattattgttcttcaaattgtatatacattttaatattttataaatatattctgcattaaaataaaaagaaaataggaatgatatggaaccagcaacgacagacaacttttttaagaattttttttttttttttttttttttttaacgaaagctattgtcttctatggaaaatgttgtttgacctattagcacttgattaggttcccctccttttcctgaaacactataacttttccctatcatgtcttgtactaaatttatgctagctgcaatgctagataacactcctccagacaggtcttagtagattaataataaatgtttatttcttgctcaagtaagaggaaaaatgagattacctataagtagcagctcattttcaaaaggtaattcaggtaccttgtatctttaaatctggtggctctgctattttcaacatgtggcttctaaggtctctgtgagaggagaaagaatgggggcttgcacatgtgggacattttcatgagcaaggcctgcattttcctccatatgctgttgacagaactcaatggcataggcccgctaactggtaatgagctggcaagtgttgcctagctgtgtgtgcaaaagaaaaagagacagatttttttttcaatagctagccattttatccatctactttccaaatatccacttaaatctttcttctttgcttaggacccatttaccaagggtgacagtccagtcccatcaccgttttgagctcaaataacaatatctccaggcagtatgcagtcttctccatccattgtaaatgtgccttcttgcggtcttgcaatctctgaattaaaaagacaagttgtctccctttcacatcttcccctctctccagagtgggagacacataacattcactggtacatggaaagaataatattctgcaggagggtggaaggggtcttttcctagcagttctccttggctcttatcactgtaggctagtgcatagccccatgcctattgtatgactgcactgtgtcagagttcaatgagttcaagtttgtactattccctgttcatgataagaactatataatagttaattgctgatagtattattatattacaacaagctcaagtaccaagtgtctttgactttggctgaaattatgtgcacactaagactagttaccatggtcatcataagctataaatggtaattttttctatatattgtttaatatgtgtgtgtgtgtgggtgtgtgtgtgtgggtgtgtgtgtgcacatgcacacatccaggaaaaattattacttgacacctactttttcttgtaaacaacaatttatagtaaatatggaaggaaatttaaagggtctgtggcttgaacatgttggaaagtcttgctttaaagctccagcagatcctttctgtactaaggcacaaaagctatgatttttcatctgcccagaataataaaattatttacaaaagcactgagaattattctttatatgatttccaaccttcaagcttctgtagaaacattgtagctttgtaaaatgtggtgccttaccttggaaaaaaaagctttgttttgaagccgaggaatagtaaagaaaactgctatgtccctagcattaaaatcttatatcctcacaatgtgaacatgcaaattaactagaagaaactacattttaaaaattgaaagatttttttctgagatgcctttgcattttggttatctcttattggtcaaccccaggtcagagttaacacacctggctctagagtaatacacatgtacaggtgttgttaaaggctgcatgatggtattctgagcctctgctctgagctctgtcctagatataaagaatgtgcagccagctgtttgtctacttgtcctgaccctgttcaaggattaatgaagagatcctctatctgtagtccaatgtctattgggtagggaccagaaatgattgaacgtctttgcttcatgatacgctgtgccagtatacatgaaaatgggaacctaaaagtactttcataagcactttgtggaacttatttcttcctttaaaatgtcctagacaccttattgtcacctcttggctccctctggtttctgtattttcactggtacattggatcaccatggcagagccctaccctgcacccaacccaatagcaggaaggtttaccttcagcttgttccctgtatgctcagtttccggtggatttattactgtttttggttgtccccagaggctggcttatcatgaagttaaggatcttgatgcctcagggcttttcacttacatagaaccttccaagcccatgggtcttgaatctttgctaaatcggtccttgctctgtatggtactgctttaactgaaacacacacaggaagctgtgtccttactttgcacagatgtattattcaacactgtgaatactgtagtaataatttttggtattttccttgtaaaacaaagagaaaagaaaacaaaatacagaattgtgctgcttttattcactgagtagtgtttcaaatcaagctagctttctggcagtgtgacatcatggcttagcaaagagtccttagaattttctaacttttaacaaaatggggaccttaaacaatctattctctgaaaaataatgttgaggtttcacagtaggaatgaaaagggtgggacgattatgatataactaactcaatttttaatgaataatgaattgcagagttaatgcttgtcagaattttccaggaattagggagaaaatgaggaagaaaattttacaagtagagttaagaggaagaggtagatgaatgcacgatcctgcttttattttatgactattaggatagagatgtttgaaacctgctgagtagctggtggaaggggaaggcttcaaggataaatagtagatggccatgcttgtcccccgacacagggaacggcctgcgcaaacacacttggtttgaggatatctgatgagttcaaagtgctttaactactaagcaggtggaatggcaggatataggagtcgtggcggccactgtaaaactcggtggttcagatgtgggtgacatgatttgcaaatataattacaaagtgatacgaactgttaaattggacaagtttagatttaggtgacagtaggacttagaagagacatctctatatttcctatgctaagctggaggtaataggagaacaaactactttatccacccctgaaaatgagactgttttactgatggaaacatcatcgtcttgaccatgagaaaaatccaagctagaatcctggccctgtggtttactagccaagattctttgaggggcattaatatttctttatgtatacattgagactctgtgatgatacctaccgcttatgcttgctgtgagcatgaatgagccaagatgtactgaagagccatgttaaatacctgtagatagttaataaatagtatctttattgttatcaagtaaatggaaagaattcaaaagaagggagaaagagagaggaatagtaaaatgtcatgagagctggaggttatttgaaaaatacatgttaatcaattgacgttatcaatcaagtaatcacgagattaccacagatacccagcttggggacaggaccacagaagaataatttgtgctgcctctcttgacgataactactttggttgaaattctgtatccctcttactttgacaaatcagaatcaagcgtggttgaatcttaaagactttttttttttctgaactaactcttactagttggcacaatagttaaatgtgtaggaggaaaagaggatgacggagaatgcatattttggtttggagagaacaaaaactgccctaggataatgtttgaatacatggccaccaacaagcccaagcttttgtggaaaaacactaaaatggctaaagcctctcagcataactgctttgctaatttaagtgtttgctttgagagtatgtgaacaaccgaattttcttagttaaatttattaaaaatgactgtacaggatggaattggccaatcagacaaaaacagttcaaaattagacgacgtttttcatcacttcacacttttgcagtgtttgctacaatcaagacactgtgcttagatgctgaacgtgatgcaaaggagttaaagatgtagtccttaccattgatttattggaagcaatagcatattacaaatactttatcttgctctacaggtaggcccgatacaagaagtgttggctatgagtaataatttggaggttcttcaaaaaactaaaaatagagctaccgtatgatccagcaatctcactgctgggtataacccaaaagaaaataaatcagtatatcaaagaggtatctacgctctcatgcgtgttgcagcactgttgacagtagctaagatttgggatcaacctaagtgtccatcagcagttgaatggataaagaaaatgtggtgcttatatacaattgagtactctttagccataacacagaaggaggtcttgttatttgcaacaacatggatggaactggaggccattattttaagtgaaataaaccaggcacagaaagacaaatgtcacatgttcttacttatttgtggaatcttaaaatcaaaacaattgaactaatggacctagagagtagaaggatggttaccagaggctgggaagggtagtgggggctggtggttggggaggtaggggtggttaataggtacaaaaaggtagttagaaagaatgcataagacctactatttgatagcacagcagggagactatagtcaataataatttaattgtacattttaaaataacctgaagagtgcagttggattctttgtaacccacaggataaatgcttgaggggatggataccccattctccatgatgtgattatttcacattgcatgcctgtatcaaagcatcccatgtaccccgtgaatatatacacctactgtgtatccacaaaaaaagtgttggaagagtgttgtgggatttcacacaaggcactgcctgggtttgtgtcactgctctgctctcctataccactcttgtcacataagcaagagacacacagtctcatatggagtgacaaattcggaaatggaaattcttttacagttaattaattcaattcagagtgtctcctcatcatcatccagcatttcctgagggtacctgttttgtgtaatgtggtaagcatagtctcttctcttatattcttccaattaattactttttctagagtttaggcccttctgccggagggagatgcctgtgtggtcacaagaatatttttctccctgcctccactttgttttggtgaccttggccatgttagttggctttattaggcttccacttcacaatctgtcaactcgattaacacaggcctccctggaatacctggctgttttgtttaagatgaatctaggaatatgacttgtttcaaatccacatgtcatcttgaaatgagcttgtctgggtctttagggttgaaatatatcccaggcttcttggctgctgatgtatatttactattttaacttcagttatctttttagtctgaaggctgaatgacttcttacagtgatcaacacaaagattatccagtagtctttggttgaatttattgtcttgacttcaatactatctatcagcaatactttgcaaggtcaacttttaaccatttttgttgttctttgccaaacattgcataaaataaaatataacctttcttctaccatattgtaatactgttgtaaaaaattaaatgatttcctactattccagtttattctctgtcaacattcttttcatactaaaaaggttggttttagcttatagatgaaatgtttttctccaaacttatttatgataataacaacaaatacttttatagtgcttagtatattccaggcactattataaacattctaaacaccttctgccattaactcattgagtcctcacaataatcttatgggtactgctaattgtgcccatttcacagatgagaagattgagggcaaagaagttaagtattttgcttatggtcacaagtgattgggccaatgtttgaaccaatcacttgtctgaaattttgcctttaactatttcacattttgcctcactgttagattttagttctttgttctgaatttggaatgcgtataaccatacaagcaaacacaaatttttattttttaacttgtaatattatggctgacctagagcagtgacatttttagtccaagacctagatacagacaacaggagatcatgtgtaaagaaaatagaataaaggtccttttttcttatgcagggccagcccaagataaaattttgtaataggttgaagtatatctttggcatcttttcacctttctctccctctctcaatttttggcactcctcctttcactttcatctattttttgctccactttgattagcagtagcctgtctaatccctgagagtaacccatacatcagacagaaactccaagtacagtgatacgggaatcaatgtaccctacctctgaccctcaaatttctcctctcagattctagcctgagaaaatatactgaaatgcaaaggtttttgcataaagatgttaatcacagcgactttcttttcagtaataaaaatttgaaaactgcctaaatgtacaacattggaagaatggttaagtaaattgtgcattatacaatacaatgcagcattatgcagccattaaaaactatgtttatgaaaacttctccatgacagaggatagtacataagtttaaatgctaagaaaattcaagttgaaagtagtataatatcaactctagaaaaatacatataaaacaaggaaagaaaaagctccaaatattaaatgtatacagattggatataaagtgattatttatagtttattccgttttctaatgtattagttttacaatctagaaaaaataaatgatcagtttttataaaaaccttcattcacaataaattgcaattttttcttaatcctcctagatatattgtcattttcaaaaatgatacttgccaatcccagtgtctttaattagtaggattctaagcagcacaagaaaatatagaaaaagattgaagaagtgtagagggaatatattcaaagtatgtagtatgtaagctgaaatagagcaaccgcaattgaattctcagatcactaaacttttcttgctttacacaaattttatctttcttaattcaattttttctttttcttttgtgctttctatttaaaagttaatgttttgttttgcattatattttttttcctctctgtgttggaagcaaagacagtaatgggaaaaggggacaagaaacggggcaaggatacactgaaggtgatatatatgatatatatatatatatatatcttcatagatggtggaattataaatggattacatatatcagatagaattaagtgtttgcaaattaaggcttgtttatactcttttgcaagcaatattttaaaatctgtttgtttattttttttatttttggaagccaagccagcagttgtttaaaattcatgcctctgcataatatatgaagactacatagatgagttttctggagatttctccttgacacatttagtttctccacgttgcttgtagaaaggatgattccattctctcaataccaccttccaccaggagaagccattttctttcctgaaggtcaacctacagccacagtagaagaggaaaccagttactgtgattccaaatataatttcccaggaggtgaaattccctctcctaaacatgaattggttacaggaaaagaaaaaagaatgtaattcgtaagactgtggagccattttcctaatccaatttctcctgtcccctagatcgatatcatgtgaattgcttccacaggggactgtgctagcagagaggggtctgtggaaagaaagaagcaccgtgctccaatggaccattattattgtttccatatcacagggtccacatatgcatgtaaatgtttttatagtacacatacacaaatgcaaaactgaatgtctaactaatgtcaagcacggtcacatacacccacactctctaatttcctgtccaaggtggtgatctgtaaaagagaggtgaactgtaagagctgaatgattagaaaataaattctaaaactcaagtgcacttaacagtggacgtaatcagtagagagaactaagacctttaggattctgatgcatctgtcacctgtaagtaaactgacagttctgtttttttaattattattaagcatgagttgctatataaatcacatctcattacaacaagccacaagtgactatctacatttttatgcaaaatgaatgctatcctactaaatgagcattgcctaatattgggagtcttttcttggtcatgcagtgatatttgctgataggggatttgacctgtcatagctttcttctagttttgtagacatttcttgttctctacctccctggttcccagcgtgcttatataatttgacaatatcttttggagcaatttgaaaatatgaatctcaggtcattggaatttgtgtattctaataaaaactggcataataattcagaagtggaattcattgaagaattatgggctcccaaatgctagtcaaattattttttatagaggtggaaagaaagggtcattctgtttttatttcaatccccaaagtatagattaaggcagcagtattctaggtcttacacaatcataggaggtgggtaacattgcaggagaggaggaaataatattcgttgactgtttactattggcaagacatcttaccaacagtttaatactctttgcaactctgagccagttggctctctctgtatatcacttttggaaaagctgaaatttgtaaattagtcccaaactctaggtcagagggtaggggagtgaaggaaggtttcattaaataaatggcccttgggctagtaattaaagatgactatgagttacctgagtaacaaggggagggaacagtgttcttagtagagggaacaacatttgcaaagaatcttcagtgggatggagcttaaaaataaggcaaacatggctgaaggacagagagtgtgggagagtactatataagctaagagggaggatataggcaggagctagatcaggcagtgctttgatggccattttaaggaattttaagcaatgggaagcttgaatcaaagactgtaacatgagcagatgtgctttttcaatacattattatagttgtggtgtggagaactgactgtgtggacacagacagactttcacttcaatcatctggatgaaacagtggtagcttagatggatgtttgtggtagagatggagagagatagagagtttggggacgatgggcagaattaatagaattcattgatatgaagatgtgaggaggtgaggaagagaaagatgtttaaggtgacatagaactctgcatcatataataaaatggatgggggtgccgtttatggagatacggaatgctcaaagacctgagttttatgaatttgatcatttttctaaataagtgcttgattaggagcatggatcacctatttggttttgaacatgtatttgccattcctgtgactcatgtaaaagaaatgtgaaaaggcagttggatctggactctagaagagaaatctagattcacaaactcgggaatgagcattgatgagaggtggagaactacaacagttattagccacatccaggagaatgagcctacaaggagaaacagaataatccaatagttaggaggaaatcaggaagatgactgttttgtggaaggcaaggtaattgatgtttcaaaacaattttgttggtttttgataatgtggaagttatgggcaagagaatgcttgggatgctcaaagaccagcaagaagaacagagtgactggagctaagtgggcaagatgattagatttaaaggttgattttaggtgtgatgagaatgcattaagaggttttgagtgaagaggggatatgacctgctttacattgtcactggactacagtgatagacagtgaaggaagcagggatggaagggcttggggggagaccaattaggagactgtgcattcaacattcagctagtatttatttaacatccagtatatgccagatatctgtaatctaggcttgtcatttggacttggacaaggaagaagtaatcaaatttgagatatattttgaagtcacagccgttgggatttgccaatggattgaaaatcgggatgtgaggaggagatgaatcaaggataatttcatggttttttggcttgggcaatagagagaattgcagtggggctgagactggtagccatagacaaggaacagaggtgaatagggagaggagcacgagttcagttctggatttgataaggaaatggtaatttttgtttataagattcttatgaggataaatgaagtaatgtctgtaaaggactttataaagagcataaacacttatcataagattattgttgttactattattagagtgggccatagtgaaaaccagtattctgatttgttgggccacctactgtgttttattcttggctttgtcactaacttgctgtgtcactttgagcaatttattggttctttctcaatctcaatctcttcctctctgaaagtttccaaagtgaacattagagatggaattgactagaagatcaggaagatcccaatcagctgtaacacccctatgatataaggctgattagtattatctcagtattattttttacattattgatattgatattttacttttatacagaagccaccttccaaagtagatttatcatattctaatgagcattgtgaatgatctcatttcagagataaaaatgttgaagggctttaattatatttaaagaaaaacagcaaaaatgaactcttatgatgaaaatcagtcatcaaaaaaaaaacctgagagatgagaaactacaacaattatccaccctcccaacatgtatgcagctattttgaaagaaaacatttggtacctgttgttagattttggaaggttacacacaaacttggaaaactgtctaaagaaaagccaagggatttttgagttttaattacttcttttaaaaagtaaacagtagtcaattaaggagccataacttgtcttctattattaaattaatggaatcatgcagtaaaatatcagtggagactgcggcattcacctggacagacactgctgttttaattatctatagagtcaaatctatccaaacaatcactctcataatgtaagagaaggaaagaaaaactaaaaactagtccatctctaatttttctcatatatcagggtttttttaagtttacttgctcttcttgcctccctgactcaatttcatccctagattattgcagcaatatcagcaactattagttattattttagttcataactatttgttattctttggatctaagttactagtatctagagtggttctgaatgaccaggtatgagcagtgtggaggattggaaagcacatattctgaagaggtgttgaactgaaacacatccttctaggtacttagctgttttgtttctaacaacttaaagatgttaaagtatgttgttcacatctgcctcaatataagtggcagaagcaacattcctggtatgaaaatatgcacccagagaacttaaaatttccttgatcaatgttaacctgctgttgcagccaatgacatatcttttacctagagctagaaggtactaaggatgaaatcttgtgggattcccatgtaatatagtctgaatgtgtgtctctgcccaaatctcatgttgaattctaattcccaatgttggaggtggggccttgtggcaggtaactaaattatagggatgagtttctcatgaagagtttagtactatccccttggtactgtcctcatgatagcgagtgagttctcctgagatctagtctttaaaagcgtgtgatgcttcgcccctctctctcactcttgctttggccgtgtgacgtggctacaccctctttgccttccaccatgattgtaagtttcctgaggcctccccagaagctgagcagatgccagcatcatgcttcctctacagcctgcagaaccatgagtcaattaaatccccttccttcaaaaattaaccattctcgggtatttctttatagcaacgcaacaatgaatgaatacaccatgggatgctgctgatgtttggatatcctctcacttctaatccctggaaagaaaaccttgcattccagagcattccatctaagcagctggaaccactccttaggtaggatctcagtggcccctgtaacaagtactatgattatagtggacaagtacaactgctcctatctattcaaatggaagaatgaagggacaatgttatagttacaaaaagtgcaaaattttattgcaaaacttcctagtaatgattctaattatctttattgaatgtctgccattttctaggcactggagtgggggttgatttggtttcccttatctacctattcaggtagataagggaaatttacgtggaagctgaagttccttactagagagagcattatcacctctaactctgaacccagtgggcactgctagttttgtagttcctggagttgcactctgcctttttttcctcacacttataactacttctccagctcctgccctggacaggcctgcactgctctgggcattctgcccactaatgactagtttttggctcatttcctccagaggctgcacagggaagagtgacctgtgtggccttatctgtaccatagattttctttcttgtgtccagctgtaatcccaatttatataaacatgtctatacctgagaccccagtcttgataccccaacatataacgtcttgctaatcaccctcacatagccctttaagaaggtattttataattaagagacttgaaactgagaggcttacttgcccaaggtgcttgggaatgcattcagatccacactgtgtttactgtactgtgctgtctccatcccattgtacattactcatttgtaattccagctgcttttgtttgagtgactagcaagtgttcaagtttcactcacatgccatactcttagaggaagtaaataacgtgtttcttgaacctcactgtgttcaggaagtactttatttaaccttgcctgcgggttaatgaatccttgctctgcttcctagggctttatgtatgattaaccaatatacctgactatatatttgaaaagttggccaaatactatatctggggcatggggttccactgcactgcagcagcgcgtatttacttgctcccagggctgtccactgttatgagagagagagaattcctactctgcattctaccccatcaccaactgcaatgtgagaagcgaatcacaattattttctcagtccctgaagtatttgctccagaaggctttatttgatgctagaaaaagattttcccataggatcaagcttgtttatggtggttaagaagaccaagaggggaagaaaatctgttagggcaatgtcagcttaagagagaagctgaaattatttattttagcaccttatttctacatacccctctgtttgattagctagacatctaaatccatgcaaagcattgtttatataacacaatctgcaagatccttacagtcatagcatcttcatcctccctcccctatgtaggcttacacaattgagaggagacaactgaagtctcaattcacgtctcacatttcacacaaagaacatcagctttttgtatcatttactctttacaaacatactattgattgccataaaaaattatctctgataacacactcataacatcctatctgttatttacccatctctgtgaaactgattatgagatttttcccaggtgactagcaggaagcaggtctgttaagggcaaaggaggaaggggtacagcttgttttgtgctgaaagaagaccagagaagtcagtgaagtcaacctcctggacacagctttttcccaagctgaccctgttgactgaggaatgccgagttacattaatgatggacactgtctgcccatcatggaaagcggagagctacatgtgtgggaaagggtagtaaactcctcctccacaactgtgcctccttccaagcttagatgacagaatattagtgtctgttatccttacgacatctctccatctggtcctctcaggatttactttatggtctgttttatttcccttttactactattagaaacaaacagctgaaaggattaatcaaaaatgttactgcttcaaagagtaaaaaacatgttacctgtttgactggtgcccatatatagttaagagtttctgaaggaagaagggtcacgcttaatagatttgatgagtccattaagcctggcttccatcttgttgctttgtttgtgcatttatttccattttggtatcttagcagtcatcttcttttagcaaacattgaggtttcagtctattgggtcagggtattagcaatacattaaccaaaccgttgaagacaaggggccagacatattcaaagtgtgatccgcattcaatatcaccattctcttgcaattgcaaagttataggcatcctttggatttttgcagcacttattttataagaaaaggagtaaataaagccacatctctgggatatgctttgagatgtttaagattgggaacattttcaggctgtctcaatactggaaatttgttgtccttttttttcacacattttctccctcttatactactctttaccaaaaggtgggtaaagataaggagatgaaaaaaatgttgcttaagtttttggttgccagctctgttttaagcctgacatagaagggggttgaaatttattttcatcattcagttaagagctattcttggctttcacaaatctcagtcctaattctgttattgtttcagataatgtagaatttgtcacattggctaaaaaaacaactccactaaatcaggacattagttttacatttcactgtgctacattctaaaataaaatgaccatttgtgctggggatgattttagaaaagcgaataagtaatataaagttttcctggttttctcatgggcagcctagaaaaatgccacaccaagactcaagaaattacattctgaattttgcatgaagataagacttgaagaaatcttatttcaacttatactttcctcagtttatgtcctgtaggaggaccctgtagagggggaatgcagaagaccagagggaagaaaatagatggtgtcaattgttatcaacacacgatagtatcacatttttattgagatataatttatatataataaaatatgagagttaaagtattaagttcaataaattttgacaggtgtatatacttgtgaacaaaacttcattaagatacagatgaattctgtcattctagaaatttctttatgcaccttcccatcctttcagaaaattcctcatgcccctcactcctccttctcctctatcactcatagaggcaaccactgatttctgtcactatagtttagtgttagctgttctcgaacttcatataaatggaaacatacagtgggtactctgttgtgcctggatttatttatttatttatttattacacctttaagttgtgggatacatgtgcagaacgtgcaggtttgttacataggtatacacgtgccatggtggtttgctacacccatcaacctgtcaactacattaggtgtttctcctaatgttatccttcccctagactcccaccccacaaaaggccccggtgtgtgatgttccccgctctgtgtccatgtgttctcattgttcaactcccacttatgagtgagaatgtgcagtgtttggttttctgttcctgtgttagtttgctgagaatgatgcaatcccattactgggtatatacccaaaggattataaatcattctcctataaagacacatgcacatgtatgtctactgcagcactcttcacgatagcaaagacttggaaccaactcaaatgcccatcaatgatacactgaataaagaaactgtggcacatacacaccatggaatactgtgcagccataaaaaaggatgagttcatgtccttttcaaggacatggatgaagtgcctggattatttagcttggtgtaatggttttgagatttatctgggttgttacatgtactagtagtttatatcttccattgtgtgagtatgccacacaatggatatttgggttgtttccagtttgggaatattatgaaggtgccatgaacattcatgtacaattttttatgccaattggctttaatgtctcttgagtgagtacttagaaatgggacggctagagcataagctaggtgcatatttagatttatgagaagtggttagttttccaaattggttataccattcttcactacctgttacccactgaatgacatactctgtgttctagccaatgctttaatgtcatttacctttttaatatgttaaagggtgtgtagtagtaactcactgtggttttaaatggcatttctctgatgaataatgatgttggataacttttcttctgcttattggctacttacacatcttcctttgtaaaatatctatgtcttttcactcattttaaaagtgaatttgtcttcttatagatttcatacatgttccttacgtattgtggatatgattctaatatgggaattgtgaatattctctcccagaatgtagcttgccttttcaatttcttaaaggatgtcttttgaagagaataattttaaaatattgataaaccctattttatcagtgttttctgttatcattagttttagcatactgtctaagaactatttgcctatcaagtttatgatataatctctttttttttcttctaggatcttcagacttttagcttatacatttatggcttatataatccatctcaagtaaatcttcatgtatagtataaggtcaagattaatttccttttcatatacatatccacttattctagtacattcatcaaaaagatgtttctctccacatttaattgcactggtgccttttacaaaagccataagtcacttatataagtgtgagtttattgatggactccatattttgttgtctatttgtctactgtatgccagtaccatactcttagttaaattttaaagttagttagcatacgttctctaactttgtttttctcttttaagatgttttagcaatttgaaatcctttaaaactacatatgaattttaacatcagcttatcaatttcttaaaaagctggctcagagtttgattggtattgctttgagtctataggttaatttagggagaattaatatgtttacaacatttagttttgcaacccgtgagtctattatctctctcaatttatttagatcatcactaatttatctcaccaatgttttgtagtttcagtgaagatagcctaagtcttttattaaatgtattcacaagcgttttctagtctttgatattgtaaattgtatagaattttaaatttaactttcaacttgtttttaatggttagtagcagttacttcctcctctgatatcctgaacccctcaaagttacccatgcggattggaatcaactttgtccaaactcttgtaaatgttaatattttgatttaaagtgaaagttgtcctgaatggtaacgcctaggttttcttctagggtttttatggttttaggtctaaggtttaagtctttaatccatcttgaattaatttttgtataaggtgtaaggaagggatccagtttcagctttctacatatggctagccagttttcccagcaccatttgttaaatagggaatcctttccccattgcttgtttttctcaggtttgtcgaagatcagatagttgtagatatgctaccattcaggacataggcatgggcaaggacttcatgtctaaaacatcaaaagcaatggcaacaaaagccaaaattgacaaatgggatctaattaaactaaagagcttctgcacagcaaaagaaactatcatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacaggcacttctcaaaagaagacatttatgcagccaaaagacgcatgaaaaaatgctcatcatcactggccatcagagaaatgcaaatcaaaaccacaatgagataccatctcacaccagttagaatggcaatcattaaaaagtcaggaaagaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactgtaaatcatgctgctataaagacacatgcacacgtatgtttattgcggcactattcacaatagcaaagacttggaaccaacccaaatgtccaacagtgatagaccggattaagaaaatgtggcagatatacaccatggaatactatgcagccataaaaaatgatgagttcatgtcctttgtagggacatggatgaaattggaaatcattattctcagtaaactatcccaaggacaaaaaaccaaacacctcttgttctcactcatagatgggaattgaacaatgagaacacatggacacaggaaggggaacatcacactctggggactgttgtggggtgaggggagtggggagggatagcattaggagatatacctaatgctaaatgacgagttaatgggtgcagcacaccaacatggcacatgtatacatacgtaactaacctgcacattgtgcacatgtaccctaaaacttaaagtataataataaaaaataaataaataaaaataaaaataaagtgaaagttgtgtgactcttcctttcacttgaaaacttagaggttcctggagggttattaattgttttaatttcactattgttttgtctcagggaatagggaggccagaggagagggagtgagataaggaacagacagtttgtggagcagttagaacacacataacatttgttaagttgaccatcttgcgtgggagtgatttgtggtgccccaaagccattatggtagtaacatgaaagatcattgatcgcagattaccataacaaatataatgataaaaataatgtttgaaatattgttagaattgccaaaatgtgacacggagagatgaaggaagcacatgctgttggaaaaatgatgctgatagacttgctgaatgcagggttgccacaaagatttaataggtaaaaaatacagtatctttcaagtacaataaaatgaggtagcttctatgtccttgtatgtttcatgggactttctatgtgcaccattatgtcttctgtgaataaaggcagtttaacgtctttgacaatttttttgtatagcattgaaaaagtttattttgagttaaaaatgtgtccttgtaaatttcttttctttttttaaaaatttcttctaaaaaaacagggtacatgtgcagaacatgcaagttggttacataggtatacatgtgacatggtggtttgctgcacctattgaccagtcctctaagttcccttccctcaacaggccctgatgtgtgtcattcccctctctgtgtccatgtattctcattgttcaactcccacttacgtgtgagaacatgtggtgtctggttttctgttcctgttttagtttgctgaggatgatagcttccagcttcatccatgtacctgcagaagacattatctcattcctttttatggctgcaaagtattccatggtgtatgtgtgtcacatttcctttatccagtctgtcactgatgggcatatggactggttccatgtctttgctattgtaaatagtgctgcaataaacatatgtgtgcatgtgtctttatagtagaatgatttatatgcctatgtatatatacccagtaatgggattgctgagtcaaatggtatttctggttctagatcctagttatgccttaaacttttattttctgtctaattgctctagctagggcctctagttacaatgctggatagcagtgatgaggtcagataatatagtaattattaaaacttcccatataaagaattcttgatccagatagcttcattaattctctaaatatttaagaaaaaaagatactaatcttatgcaatttatttaagaaaataatggagaaaagaacacttcccagcttgttttatgaggctagcattacttgacatgaaaacctgacaaggacattattagaaaagaaatcatggaccaataatgttatgagcatagacataaaaattcgtaataaaacattagaaaattaaacccagtgatatgcataaagacaaatttaccagggaatgcaaggttagtttcatatttgaaaatcagtagtgcaagtcatcatatttaacagaataaaggagaaaaatcatataatcatctcaatagatgctgaaaagcgtttgaaaaaaaggtaactcctgttcatgattaaatctctcagcaaacttggaatagaagagatatttctcatttgataaaggaaatctataataaacctacagcaaacaacacatataatgatgaaacattaaaacatttctctgtggaatttgatcttacttgcttatactttcattaaatgcatatatgacattttgtaaaatctcagttgctattattgtattattatgacctacatttagttagatgaaaaacacttttctggtacccaacaatttgtcattgccgtttagataccatttaacagtttttctgttgcatctacaagctgggtccacaccagattgggagcacactccaaagcaggacttctctgtttagcttccccctttccatgtttaaaaactttcaactgtcagaaaaatacagggaaaaatgttgtatcatgaaaccaagtaatggttcttctattaactcaaatactaaagtatgactatttgattagggatgctagatgtgagaatggaaataaagggatacaagaggcatttaaaaatagatagttggccggacacagtggctcacgcctgtgatcccagcaccttgggaggccgaggcgggcagatcacgaggtcaggagatcgagaccatcctggctaacacggtgaaaccccgtctctactaaaaatacaaaaaattagcctggcatggtggcgggtggctgtagtcccagctacttgggaggctgaggcaggagaatggcgtgaacctgggaggcagagcttgcagtgagccaagatcgcgccaccacactccagcctgggtgacagagcaagagcttgcagtgagccaagatcgcgccaccacactccagcctgggtgacagagcaagactccatctcaaaaaaaaaaaaaaaaaagatagttctggaattctgagtgtacacagaagataaaggatggagataggatgaataaagaataggagattttgtacatgttattttcttttctgagattagtcttgcctcttgtctttgactagtcaattcctcctcatcttgtttttaatcaacttttttgagataatggtagattgacatgcagttgcaagaaataatacagagagatactctgtatcttttactcagtttgccccaacggtgatatcttgcaaaactataatacaatatcacaatcagaatattgacattgatacagtcatgataaatagcattttcatcactacaagaatccttcattttgtgcttttacagccatgatgacttccctcctgaccccattccctgcttagcccctggcaactactattcctataattatgtgatttcaagattgttatataaatgaaatgatgtagtataatatgtattgaaggtagatagagtgattcctcccacttcataattaattttttcaaatatatttagcaattctaatttttctcctcatatgaattttagaataatctatatatacaaaatattttgctgagatattttataggaattttgttaaacttgtaatgtcaattatgggagaatttacatgttttttatgtagtatcttcgaatccatgaacacaatatgtatcctcatttacttacatcttctttgatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaagggtccccagagtgtgatattccccttcctgtgtccatgtgatctcattgttcaattcccacctatgagtgagaatatgcggtgtttgatcttctttgatttatttcatcagtgttttatagttttcagtatacaagttagaactattgttatatttattatacctaaatatttttattttttgagtgattataagtgttactgttttcaattttggtgttcacatatatattgctagtatatagaaacacaatttattttgtatgtttatcttgtatcttgcaaccttactgaactcacttattagttctatgcactttttttatagattctttgggcttttctaaacagaaaaacctgtcatctggaagtagggactgttttctttctttctttgcagtcagtctaccatttatttcgttttcttgtcttcttggactggctagaacttccagtactatattgaataaaagcagtgagagcagaaatgcttgccttgtttctgagaatagtgaggaagcattcagtcttttatcatcatgtgtaatgttagctgtaggttttttgtagatactcttcatcaaactgaagttctcctctatgcctgtgtttctgagagtttttatcaggggtaagtattgaattttggcaaatactttttctatatcctgtgtagttttccaaacttggaaactcttctgcactctagctgccttcacatgggcaagtgttttcatatcattctgtgttcctctgtatgctttgccagaaaggagttcaccttaaattttaagacaatgttgtggatagagaaaagaaaaactttctgtgtcatggaaaagaggtcagaatttgggccaagattttactcctggctcttttatcaggccaggattttactcctggctccttctatcctttgcatagtgagatcatattctctttgagtctgtttcttcatttacaaatagaagaaaaatagctgcagtgatgatcaggtgacttgatagaggaaatgcttagtcaatgtaattggtttatagatagtaattaatgtgagagttttccccagatttttatagtcttcctttatcatttattgctttaccacaataagtcatttgtcaaggaggaacacgtatatttccctagagaacacaccgatatgagaacatacgaagcctacactcctcattcaggaacaggcaagagacaagtgtacatctagttccaccaagaaaacacacacacacattaacataccagtaatagtaagaaagcttttatggagattctgaaacatctattagaccttgaaagataacttagtatttacatgggaggagacacacttcaacctaccacgttaaaaaagatcccctgagttgtatcctgagctgtcgtagataagtgtcttcacccctctgttactagcctgtgttcagtctagtaaaaagcctgcaatgagaaaggaacaatgacttctttggaaagagaaaagtgtatatgttttggggtgggattaagagaaacagagaaaccaaatgttcctatgggaagctggaacttactcagcattcacttgagaggaaggacaacaagcccctgtgcaaacccctaggaaatgtcagtagagtcaatttctgaaaaatagataaacagcttggtaaagtaagctaaagaataatagtgatacatcccagattttccaggatatttctgattgaaattgtccaattcatttttggtgatgttttaatttttgatttgggaaacacgaacactatacttctatgtttagctttagtgatttttctgccacaagcaatactctagactttagttgagtttttccctcttaattaaataattcttatttgaatatatttatgtttattttaaaaaaggctactgagtacgagattaccacttgttacgatcttgctccttggagcagaacgtgacatctcatatgtatatatacttagctctcttgggcaaaagcttctccctttgttccacatggtcatctgaacattccgtgaagcatttctatcctcccaggatgttttatttcttgttttcatgggtgaagagagactgttttataaaagttttcaaatacttactggatttgtatcctaaagggagaaagcagcaggtcattttttttttctttcaagggcttgctgtaagttggtcttcctcttaacacgaagaaaagaatgacattcttcatgaccgccattgtgagtaggctgtattacattaaagccccattattagcaggctgtgccttggctgattttatagagagctcaggaacagaagtgtagaacaaaaacactgatatttttcactggcacaaactgcagatactttacttgttgattaatttgttaaaatgtgtggcagaacatttagttatcaggtagtcattctgagtaaactagagtcctatgctcctttaacaatggaaaaattatattttcctttttctaatatcccagtgttgtatgtatgctcatttatgttcttggtttaacaggaacattgaacattccctcactttgaatctactctaactcctgtgtttgtgtattttcaccacagtaagccataatatataaaatagtacaattaagaaaaccttagccagcacggtggctcttgcctataatcccagtactttgggaggctgaggcaggtggatcacttgaggtcaggagttccagaccagctttcccaacatgcggaaaccccgtctctactaaaaatacaaaaatgagctgggcgtggtggcagttacctgtaatcccagctactcaggaggctaaggctggagaattgattgaacctggaggcggaggttgcagtgagccgagattgtgccattgtgccattacactccagcctgggtgacaagagcaaaactctttctcaaaaaaaaaaaaaaaaaaacttaagtaatcttcataagtaaatgatatatacttaaatacaaattatcacatttataaaagaaattttctgtatttgtccaacatcggtcaaattccttaatcttataacaattgacacaagaacaagaactgccacccagtccacatttatcttctctatcatatttaagatattgcagggctggagtatcttcttaggatatactttcatcacaacagataacctattacatcagagattcaaagaagtagaatgggagagagaaggagttatattttttttaccctaaatgatgtcatcaagtcactatgctaatggagattgctgcacttgagattatgtgccttacaaaataatttaataatgactttagacagctgatatttcccatatagaaaataagaattcagcttatttatattctggaaagaaccatatctgctgcttagagtgaagcagacctgcagtttacacaacagttgagaataatcttgtttaccaagctctttggataaatagaaaaatatccaccttatcttgagttgctgtggtaatcagctgaattagtttactacttaagctctctggaagatgattggtgcatcatctgtgaagatgactggaatgttagcccactgaagttataacttgtggaacactgttcaaattaccgaaaagagtaaatcaactatctgctggtactcagttctcagggagcagtttacaccttgaaaaatcagatccaacacatactaaccatagtttctcatgttatgatttctggtggaattcctttagactcagccttattcttcaagatactgaatttttgggaaccctaagtacagtttctccttcttacatagagacttgatgttcctaactggtcgcaaacttgggttcatcagaagaatctgctccccttgtgagcacaaataatatctcagtgaagagaaagacactgtcatagaagagtcaacatttatggaatttcctggaatccacagttatcttaaactctgttccactttctctggacaccagctaccttcaatagtgccaggttcagtgtctaaccatggagtatctcatagttggactgggtgagtgcagatgcagttgcatgagattttgaaacatcacattataaaaaaaaattttcaggtatgcaaaaggcaggagagaacatgtactccttaccctgctttaaaaatttctcaacattttgccaattttgtgtcatctattccccccaatcataacattttttgctgaaatattgtaaagcaaatccaaaacattatttcattttacctataaatacttcaataatttacatgggtttttaatggcttgctatttattttcagggtttcttttagtatctttgacctctgtcacagctcatcttgcaaggttgcctatctcattgtcagagagctctagctaaagctcattcatcgttttgtgaactatgaggccacatattctgtgttgacccaagttgggccagaaagacagttttcaagagggcatggcttctaggtctctgccgcagcttgtccactttctttcattgtcagctactagaactatggcagcccatgctgggatataatttttcattgggcacagaaaaagagggtggcgttaggcagaatcaaaagtaggagctaagaaaatgaaaaagacaaggcagaaaatatgccaaaggtgcatatttaagggataaggggaggaatctgtgatgttgaggatgagtccccttgaagtaggggtgcacacaagagtctcccaacttgtgaattactaaggacaccaatggtgaactaatttataatagttgtctcctgtgactgagaaggctgagagtggggattatcagtaagaaaatagctcagaggcaaccaagttgtatggatctttagaaagggaagcaaggaaatagacaaaggacaacttcactgaaaacatttatgaagtattcagtaatgttttaacttctttttaatgagaaacagcaaaccctaaggggaaacactctggggtgtttatgtccagggtcagcaaggctccagggttatgtcttattcagacatattcaggagtaccggggagagagaatactccaggaaataggtgttggcatctgtggaaaggagagaaagtcagactgtatcctagagtcttagggataaatatagagtggaaaacatgaaatcatcttgtgaacacagggcagctattgaggcttggcaggtaggttggggttattgtgaaaaagttcccagcaatccaaagagatgttttatctttgacattgtgccgcctgtgccttgagttagaaaggtacacacacgtgtgagttaagaaaaacttctgatactaaattatttatagttaaacctctagtaaaaccctgaattcaaaaatatttgtagcagaatacaaatattctttttgttttgtcatttatcctggtaaaagtcaagttgctgcagcgtgatggttctggtactgaaatggtcttaggaaagtggaggaggagtggagttacatgtttttaaaaacttgttttgtggctgcatagtattccatggtgtaggatgaagctggaaaccatcattctcagcaaactatcgcaaggacaaaaaaccaaacaccgcatgttctcactcataggtgggaattgaacaatgagaacacttggacacaggaaggggaacatcacacaccggggcctgttgtggggtgggggtaggggggagggatagcattaggagatatacctaatgtaaatgacgagttaatgggtgcagcacaccaacatggtgcatgtatacatatgtaacaaacctacacgttgtgcacatgtaccctagaacttaaagtataataaacatatatatatatatatatatatatatacatatataaacttgttttgtgaattttgaaatagttttacacatacataggcattgcgataatgctacggacagttcccacagtccctgttacctagtgtccatcatggaaagcatataacgtaatcatagcacaattatcaaaaccaggaaatcaacattggtaaatgctattaactaaaccatagatcttttccagatttcagtagttcttacatgcaatcattttcctttatagcatatggttcactgaaactttatcacatgtatagatttgtgtaaccaccactacaatcagaatggagatctcttcaatcatcccaaaggaactctttggtgcagtccctttgtaatcttgtcctttccccaacctaatgcctggcagccactaatctccatcattaaaaatttgtcatttcaagaatgttatatgaatagaataataactatgcaaccttttgagattgactttttttcccattcagcgtaacacctgagatttatctaagttgtgtgtttcagttgctgagtaagattctattttatggatgtaacacagattgtgtatccattcatgtgtgttgaagggcatttgggtttttttcccccaatttggggctattactgaaattatattttactgttttttcctaaatatatgaatctgaaagtgtatctgtatcatttaagacttaactccatgtggaattaatttctagaagcgtgaagaacaggttaccagttctcccaggattgctatgatgactaatttttagctgaataaaatatgaatatatctattcatttttatatgtgtcaagaatgtgctgagagttataggaaaacagaaaggtaataattgttaccaaatcatgaggagtgcccaagttctaaaaaacccacaaagtcaaagaatggtgcatggctatagtttcagaattattttctcagagagtgccagagccaatcttcttggtacctgagggtaaacacccaacctcttgttcctcacttagactttcttctatacttggcttttctccatgaagggtactgtttcagcacattggacagaaaaatacaagcacagtgcaaaaataggtgtgaatgttgtactgattcaggtaccagtatgtgttttgaaagttaactctgcttttctagtgatacttactttggataaaacctaggtcaagcctgttcaaaactgttacccgaaggcaattattcaacattataagcacatggtttccagatcattcatcattttatttaacttcttgagtacataaagtttttatcccatttgtgagtcttgatgcacacaattgactaactgtgtttgggttattttctcttccacattgggaaaaactatctttcatgatctatctcccttttcaaagctgttaaacttttgtcttctttaaatgattttctgtgatgatccagtgtttcttgtcacgtttctgtacctatatgtgctactgttgtgtatttgtttgttcatcctgcctctcccacggaaagacctgtcttctgttcttcgtcaccaagactctctacacagtaagggctccatctgttttgactgttgacctactgaagggacatgcctttgcggacagattcaacacaaggttgaggattaaacccaggcttattttccttcggattttctcaacaatccttccatctcctagtagtatctattctcttctagcaactttttttttaaataataaaattgccttggtcttctaggaccctctgggaaggtaggtgtcaggatggaaagtaggttggtctgatcaagggagtcctgtcatgggaggtgagaagacctgggatctggtactggatttgcttctcactcctaacatgatcatgaaaatattttctgcttccttccttattagcaaaatcaggtagatataaaaggctctgaagcagactgggttgttgtaatggcaaagggggaacctaaaaaattctggactgagatgtgggagtcacaccattgtccactgcagacataccaaacaagccaccttaatttagagcacaggcttgtgagtctagtgatgctgttcaatcatacattttaatctctataaaatgtaatctcctatgcacaaaggtagtaccaatagcacttgagtgcctcgaagagagttttgcccaaaaagcagcagacttactgtatgatatgtccatctgtgaaggtcctggctcagactgagctgacagtatggaagtctactctaatgcagaaaggttggaaacctgtaattattgttaaaagtttagggttgtggaacctatttttatagcaagacaaacttgctctggtattggcccatggatgggtaaaagaaagtaaatgctttcaccttttaaaaaggggaaagtgtggcactgtcagcatggctcagtgctcactgtcatcctgctgctacatcatgtgcttgatgcactgtcatttgggtgataacatcacatttaagtcatgatcatttattcccagtgtcagagtgaaggagtcctgttcatttgagtttcagtattcctcaaactggatttcaaaaagaatttcttccaaaagaattcatcaaggactaccgtaatttcataccaggaagaaaactgtcaaaatatgtcatgagtccaactaaaaacctagctcaaaccatcatagtctctcatccaaactactaaattgacttcctaactaggttcctgcattgactcttgctcctccatagtcggtgctccacacaacagccagagggatcttttaaaattaaaattctgttgaaaatataatacccatcacaaagcctttggcagttttctcttagaagtgcatgcttttacttagcttcaagcaatagtatcttctacctgtaggtcttctctctccatatataagtccttcctatcttttcaaatccagattttacattcgaatatccttcaggagatgtttaatgatccccccagctgataaaagttaccttctctgagttttttatgacacagtatttgtatattttatgccatgtatcagttttctaccttgtatcatagtaatttacgtaccttcatcctttctctactttgaatttattgaggacagattctgtgttttacaaatctgcattgggtactcaataaatatttgtgaaataactaaataaatgagctgtgttaaaattaaaaaaaaaaagaaaaagaagtgcatgcaataaaaatggcttgctatggctcacaggaaccaagtgtgatctggcctgagtcagtcttttcaacttcccctcctgccactctcccctttgctggctttcctccaagtacactggggtttttacttttctttggatcttcctcagggcctttgcacttgtggttgcctctactgggcacttcatattcccccagatttttgcctgactcccctacttcatttatgatcaacatgtaatcactccctcattctttccttattctctatcccttaccatgctttatttttcttcatgacccttatatatcttagatcataatatatatttatttgttggcttatttcctgccttcctgtctagagtgtaaccttcttgagagcagtgacattgtctttttcatactgcatcccatgcctgtagtgtctggcacagaacaggtttttgattaatagtctttgaatgggtgaaagagaatagaggtatctggcatagtcgggggtcaagtcagcctgaggtcaaatccaaatcttgtagattcgggatattaatcatttgttagatacatagtttgcaaatattttctccaattctgtaggttgtctcctcactctattgattatttctgttgctttgcagaagctttttatttaaattaagtcccagttgtctgcaaggaacttagacaagaacaacaacaaaaaacaatcccattaaaagggggctttaaagtacacgaacagacatttctcaaaagaagatatgcaagttgtcaacaaacatgaaaaaatgcacaccatcagtaatcagagacatgcaaattaaaaccacaatgcaataccattttataccagtcagaatagttattattaaaaagtcacacacacaaaaaaacccaacagatgttgatgaggatgcagaaaaaacagaaccattatacattgttggtgggaaggtaaattagtacaacccctatggaaaacagtgtggagatttctcaaagagccaaaaatagaactactattcaatccagtaatcccaccaccagatatctacacaaaagaaaacaaatcattttattaaaaaagagatacctgtactcatatatttatcacagtactattcacaatagcaaagtcatggcatcagcacctaagtgtccatcatggaggactggataaggaaagtgtggcatatataccacagaatacaactcaaccgcaaaacagaatgaaatcatgtcttttgcatcaacaggtatgaacctggaggccattatcctaagtgaaagaactcagaaacagaaagtcaagtatcacgttctcacttatgagtgagagataaacaatgggtgtacatagacaagatggaaataatgcactctgaggaccccaaaagcacagaggatgggaggggtttgaggtttgaaaaattacatagtatgtacagtgttcgctattcaggcaatggtcacactaaaagcccagactcaccactacacagtatatcaatggaacaaaactgtacttgtacctcttaaatatattttaaaaatccatactttggccgggtgcggtggctcacgcctgtaatcccagcacggaggccaaggcaggcggatcatgatgtcaggagatcgacaccatcctggctaacatggtgaaaccccgtctctactaaaaatacaaaaaattagctgggcatgatggtgggtgcctgtagtcccagctactcgggaggctgaggcaggagaatggtgtgaacccaggaggtggagcttgcagtgagccgagatcatgccaccacactccagcctgggcgacagagcaagactccgtctcaaaaaaaaaaaaaaaaaaaaaaaaaaaattcatactttactagtgggcgattattggaatatgaagcatttcagtttaactttgtaagctttagtctttgtgttttaaaatgtgtctgatgctgtcttcttcatagtttgttaggagcactaaatgaatagtagaaagcctgccagaaagtgatttagtctgaatctataaagctgtttctgagcactgactgtaaagtgcactagaagctcaaatttttaggttttgtcattttgtgacaggttgatgtggaactcgaggggttggccaaagccctcagagggttgtaggccatgaaagttcgagaaccactgggccatgtccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccatgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttgtcatttagcattaggtatatctcctaatgctattcctccccctccccctaccccacaacagtccctggtgtgtgatgttccccttcctgtgtccatgtgctctcattgttcaattcccacctatgagtgggaacatgcggtgtttggttttttgtccttgcgatagtttgctgagaatgatggtttccagcttcatccatgtccctacaaaggacatgaactcatcattttttatggctgcatagtaacagcaggttctggagaggatgtggagaaataggaacacttttacactgttggtggggctgtaaactagttcaaccattgtggaagtcggtgtggcaattcctcagggatctagaactagaaatacacgtatgtttattgtggcactattcacaatagcgaagacttggaacccacttcccacttttgtttcctttaattgcccttatgagaccacatccaaaatcccaagtcctgccaagtgaatgcagtacttaaagatttgactactggatgtctggtcttggagaaaacagtcaagagctggagcaagacagagagcagcatacctgtaatacagcttattaaaataatgcaaacacttctgtaatatgtatgaggtgccaggtagtctgccaagaacttttcatctattaatttgtttagtctttacaactgttcactccacttcctgttagggagatagctgttgttggacccaatgtagagatgaggaaacactgaggaccagagagtaggcatccaaggtcacagagttgggcatgcgtggggcagagccccaggctcaggcattctggatcccaggcccatgtgcctgcatggtagagggggagctggcactagcccttgtgcccccaaatatcctggctgcattgttcccctgttcttagttcatttgtgttactataaaggaatacctgaagctgggtaatttataaagaaaagaggtttatttggcttggaggtctgcaggctatacaagaagcgtggcgccacatcatctgcttctgatgagggccttaggaagcttccacccatggcagaaggaaaaaggaacagatattacatggtgaaacaggaaggaagacagagcgggggagatgccaggctctttttaacagccaggttggcagggggtgtgtggggagactcttgtgggaactaatagagtgaaaactcagtcattaccttgaggatagcaccaagccattcatgagggatccacccctatgacccagatacattccaccaggccccacctctaacattggagattaaatttcaacataaggtatggaggggacaaatatccaaactctattatccccataaatggttaaactccgggagagacaactatgcacctctcaatcccaaggtgagttgggattcacgattggttaaaacttcatcagaaccatccacattggaaatcacatctaaaacttgagtaattttatggtttacaaagcatattgacttccttgatttattcatgttgccagctgccctccgaggcagaggatcttttcacttttctcctattactcaatgccactactgagcctctgcactgaccctacggcttcctgtcgtactctctgcaatgctacatgtcccttctagtctagggcgatcctggtggaagcatgaagccagccagcctctctctggtcaccaccatcacttcattccttatatataccaggcatgggaatgtttcttttgcttgttaatttttgttcttgctcttatctgcatttatcttccttcccccaagtgtactgccagaccctggagaacagggaggggaattgtttttcctttattattctttcctcagttcctgctgtagaactgtacatctagtcaatgcttaataaatgctggtaagttgaattatcaacactgaacgtagaaatgcactgttgcctggcttgttagttttgtaagaatagggataataatagtagcaactaatgtgtacagatttgactatgtgacattatttaagggctttgcacacattaatccatttaatcctctccatgacctaaagcactgctatgctgaagtgcattttgcctatggagaaatgactggtttttgggaagccaatgtgcagaaggccttgtttcactacccctaaaacagtgcatgtgcaggaggactgttattgctgtgctttggaaggtctgtggatgaggaaatgtagaattgcagatttatgggttggaagttgatttagaagacacatgtaacagaagtaacaatcttatcagacttaccagtgtcttccacttatttccttaacttcagatgctcaggaacgacagcacctgcagaatgcatccactgctgaaaaatgagagctgtttcttgttggtactcttcagggacattttagcatagtggtggactccagtgttgacttttcttttcatcatctgtttgatcttggtggattcttaagaatctctggacctgagtttgttcatctgttgattggggttcatggtagccacttctcaaggttatgattgaggtgaaatgagatgctatgtgtgcaaaggacctggtagcaagaatgacatgggaaggagggcttgctcaataaacattgcctgttatagtgtgctggcattaccttaaaatccttaataagctgtaagttttggatgagagtcagaagtgttgggttggtgaagcattttgctacagattgcaggcttttctccggtgtcacaaggcattgaaaacgcttgttcggagacagcccagaagggaaaaaaaaaaaaattctggaaagcctggcattttgtgctatgttgtgagtaagacatttatagttattgagccaaaatttccactgtaatagaaaaagcagttgcttttaaacttctggtccaatttagtaattatgggtgagttaaaatgtaggccatttgaattggatttggaggatcaagtaagattctgtcctacagtggggatgactcatagaggaggtagcttgacatagtggaaatagaagctgataaggagccaggagacccaagttcctgtcctggatttgcacaaataaactgtaatagcctttaggcaaattattaaacatctcagttttctattatataaaatgagagggctgtgtttgtgaatggatctttcaacatgcttaaggttataccaaacagatcactgaaaatgaaatatgttatctacagtcattagggaataaagtattcttgctagtgcaatatacttatttggagaggattacaacataaacaagaaccaacgagaatacatcagtgccagaatgatacagacataagcagacacctgaggctctctgatacccgcaggtcattgctatgtcctaggaaaacatagccatgctagttataagagttttctgatgatgagtctttataaacagaggatttactgggaactagagatggaatttttaaatgatttccatgttatggatgacctgtacttgggcttatgatagctctgccacatcttgagaaataatttattgactaaactcgagttggcaaatgtaaaaactcatttgggttagctagcttgtttacttgttcttggcattctttcttcttcttatttcagttgtaggcatgaagccacattttgggctgatcatctttataataggcttatggttttataacatcagattttgaatgatagcattttctgctctctgtgtttcctatcacctgtagaattaagataggtcaaatatggaacagatggattgaatgattccctagaattattcactgacattataagggtgcctcctgtggcacaaatagaaatatttctgagagttgtaaaaattaaatttttaaaaatcgaatccaatttttctattgacctgcgttagaatttctgagacattctatcttcatttctgattgattttcaattagcaaaggttcctgccattttaactttaaatttcttagttcccctttttcctccaagtggttaatgatctgtgaacaaatattggagcaaatcagagatgcttcagtgtacagtcaccctatagatatttctggtgtgcaagggagtgagctacctgggagatgaggaaccttggttctagtgttttctctgccaccacagaggtatgcatctttgaataaggtctttttgcctgtttcaggcaccattctctcatttgtaaattatgagctccattgatcctatctggcttcaatattctaccgacaattgagtgggaaaaggaaactttctctgaatcataatctctcaacttttcttttcataaattttcttaaagtggattatacctatctgtaagtggataacagcctccatttattatccttatttttatttggctttttttttgacttgcaaattcctttttggatggattagattgaaaatctttgggaggctcaatcagcccagacagatttattcattctttattctggatgaagaagaggaaatagtttaagatagatctgacatggaacattaatttgattgaagcctttctgtgtgaggagtaattgtagcatcttcattgtcataatggagagattagcatggattagattagcttgtgtacaaaggttgtacaaattgattgctgtgatttgtaggctgggctgatctttatagtcactggcatgacttcttaagcattatagtcatgatttctttcatgtggtttacatgtggcaacaagaaaagcacatttccctcgttaccaaaaccttgtgtctcccaatgggaacttgacatagactcaaaaacataagacgtgtacatataatattaaggagatggcactggtcatctggcctgctgtctgggatgacagcacacattggccaaagacagaagagttcccaaaacagatgttcagagaagatggctagaatactgttgaaatgtggtctagaataattatgaacataagcctaaaaaggtagccaagatatggctctgaattatagccagtcatgggattattatttaactccagtttagtatgtttcctgccaagtatgtgccagaccctctgaaacagaatctggtttttgccagcagtgcttagcaactctatattttaagtctaaattccaaaaaaaaaaggaagagtaaagaatactaaactgctttctgatgggagtaagttgtatttcaagtggcctcagaaatctttttctctagaggagactttctgtggctaagaggaagagagtgggcacttctcccctccactgaacccacctggacttggtctctctcccaaggctttcactgcaattgaaaggctttttcactgccctaggtctctctcctaaggctttcactgcaattggtacatgtgttcagtgactattagaacttaaatgatcactctcatcccacctcactgatctcattttccaaatttctccctcttgctctcccattctagggaatctggccttcttcttggtcttcagatgcactgaacatcttcctgcttgaggatgtttgctgccttaccttactctgctggaaagcaattccttccaatggtgcaggtctcacttccttacttccttcagattttcgctcagataccatgttattcatgaggcttccctggccaccccatttaaaagcagcaccccaccagcattgcctatcacccccaccctgctctgtattacctgataacactaatgaccgtctggcagattatatctttatttgcatatttattatctgtattctgtctttagaatgaagacagaggctttattccagtgactgaaacaatgcctgacatgtaatggaactcaataaataattgttgaaataatgaatgaataaatgattagcctttaatttgtattcattcgtacacattacattggggttttctagaagacagtatgaaaatttcacttaatttgtgactcaagtacagaaagaacgatagagatcagaggttcttaaacaactatccatgaacccaacgctgtgctttacaaaatttaacgtgcatgtgaatcgacagaggatctcgttaaaatgtgaactgtgatttagtagtctaaattggggtctcgggttctgtgtgtccgacaggctcacatacgatgcggatgttgctggttctaagattgcactttgaggagaaagactctaaagtacctgtggaagggattcaaggggttcacaaagccagggttatgaatgtccagtatcattgttatagcaaagaactgaagtgctagtttctagaaatttctggtttatgcaataccaatgaacagatcatttattggacattcattgcagagctttcaactgttaactatgcatggttgttctgtatgcagacataaatataggtataggagaatttctttttctgaggaaataatagaaaatattcatcagtttgtcaaaaggatcagtccaaacaatggtgacagccattgttaatggatgatggcattaaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggccaaaatgccctcaaaggggccttggtgtagaaaagctgttttcaggcaaaaaaaaaaaaaaacaaaaaacacaacagcccatcaagagctgcatagcttttcagtcaggaaacttacccccaggtggatgtttctcagccaaggagtgtgggcaatttagtttcaaaagtaatttggaacaactgagatgttttatattaaatggtcctactaaatagacatctagcacagggcttagccaaattctagaaggcctcgcatggtatggtatcacgatcctcataattgctaaaaatattactcataatcataatggctaacaattattgagtctaaatatatgctaggcaaggtgctactaaccttccatacattttcttatacaatatttataaaactaattcggatggtactataagtttttttgttttgcagaaaaggaaactaatgcatggatatgtgatttatattgctcaaggtgacaaaattgttgagttgtagaattgggactcaaattcagatatgctgattccggggctcatcctgctaatgactgtgctgtactcataatcataacaaattgatttttggtgaccttgaaaccctgcttaggaaactaaattttaagattttggttgaatttaccctcagggtggagaaaacacaggttttcataaacttactgtcatcaaattaactatcctatattatttttcagaataaacactcactacttgttaaggaaatcatggtgaaacttattcatatgagctaagagcttctgcattcccatttcatggaaacgtggattttccacgtgtggctctgtagcatggcaaaatagcttggtgtgcaaaaataccctagggtaaagataaatgtaattgtttttgaaatcaaccacttgtccctaatgctcaatctgtgcttctgagaatttgccgagtttcaatgctttaatgtgtgtattgaacagggctttctgttgcaaatagcagaatttgcacacgctagttgaatcagaaaacaataacgtaacaacagatactaataaacacgtagaatctcggagagtgccaaagagcagggttctggggctacacagccacaccttaggacttctctctaatcatatgacttctcagcacctgtgatgccaggacttggcctcccaaagctgaggaaccaaatgcctcaccaactgctcctgccagaaaactggttctccctggtttggtgcccatactctttgaattttctggctttaaaaattggactcatggtgtgagaaaattccaaaatgtaggaagatcttcaaagatgttgagcagtcaccacgaggaagcttccaatgttgtgtatttcagatcagtgttgtggagtatctttccctttatcacacttttccttcatttttactccctttgattgctaaatctttacagagagcagggactctgttcattcagtccccagaatggcaatgtgttaagtccacaagaaggcttttcgtggacttttggagtctgatcataaaggagaaatatgtcttaaaaaggcagtggaggtgatgtggtgaattttgtgcttagcatttttaacttgagaaaaatgataagacaggccagtcaacacacaatgggcaaatggagataggtgactgtaattcagaagtgcacacaggactccaggtttgagtatgggagttgtccttcaaggattggcagttgaagcattcaccagagcatggatgtgttttctgagcaagagctgtcaataattaggatagaaaactgaacgtggaaccctgaagacctctcaccctgtgccaaagtccaggtgcagaaaagaaaggtgagcttgtgataaagagcaggcagagttcagaagacagccatattattttggtgtcataggggttaaaggaggcaattcatgagaattgattgcttttttctcactctttattgagatatagcttctcaaatgtaaagcatgatttgaaagagatcagtaacaacagttatgcattacatttgaggtgtgttttgtacttttcaaatttgttttcaaatccccatcacttcatttaacttcattcagacacttaaattgaaaattactttctatgtgtggttaaaaaaatcttgcattatttttgtttttttctttaatctaacttaaacatggaagaaaattcagttgtgtgtagttaatcacaggtttgaagaaattaccttaattctattttgagaaagaaagagtatcatgtggtatacagagtgaaggcttggatacctccgttgcacaagtttcctgcttagctgggacctggtcaggccacttcacctcccatttaaaacatcctttagaactaggtatggagctaatgttttagatatgaaaaataattattcacagcgtgttactataaaacatatgttcatagattcttacatttgtatacaaaacaagaaatcacaaagctttattcatgcagaaaaaattaatttgaaaaagcccactgtatgccaagaaatattcttgatgcttggaggtttggggttgaggtagcaatggggagataaaatgaatatggcttgcttcttgctttctgcaaagaattgagtttcgattctgacttaagagacataaacaaggaaaagtacattctccatgctgcatatgtgtggcttaggccctggcttgatgaagggagatttggtattttgttaatgtaggaaaaactaaaccaaagtgtcttttctattctctcatttaacagtagtcaacacagaagacttctgtgacctctagtcaccaagaagtgtgtggggatttctcactaccaacaaataaaccatcagttctgcagctgacactagctgggtgtcctctaattcaatgctactctgacactgtctacctggagatacagtcagatccctcagcttgagagctcagtccctaagactgtttcctcccctcactgcagatgccagtcacaagctccagtttgttgcgtctgtgcttccagccagctggctataaattggggttccctcaacttcccccttgggtttgattaagttggtagagtgattcacataactcaggaaaacacttacttacatttaccatttaccagtttattatacagaatattgtaaagaatacagatgaagaaatgtgtaaggtaaggcatgggtggtgggggacagagcttctatgcccttcctgggtgggccgtcctccaggaaactctgtatattctgttacccagaagctctctgaacccaatccttttgggtttttacagaggcttcattatataggtgtgattgattaaaccatcggaccctggtaatcaacttaactttcagcctctctccatccccagaggttgtggggtgaggttgaaagttccaaacctctaatcatgatttggtctatccagtgaccagcccccatcctgaagctacccaagactggcagccagcagtcaactcattggcatacaaaatacatagtttggaggctccactgattttcagtgtggtaccccaggaaagtggatgaagaccaaacatgtatttcatgaagccttctatttcagtagtaagaaaaatactaaattataatacgaatttttttataccagcaaagcagttgcatttgcatctttaaaatgcaagtgcaacttctttttagagatctattgcattttaaagatgcatttcatcacttattacagccaaatgacttgcccaggcattagattttctgttgcagtgatagcagggatttaaataatgattatcttctctttgacctggtgaatttcttattaccctgcatatagacatggttggattgtactgactttgcaaataccacacaactgaagttggatttctgttgtccttcaatcaaccatctacctaagcctcaaaccgttttgttttgcttaaaaacagaatgagtttggcaaacctagaaaagtacacaaaggatcatccatggatataggatggaagatgtatgaatatggaccaacaacagtgtttattttaataattctaatattgttataagttgtcataagcttattttcgtaattagagaatagtcttcaatttacactgaatgcatgtttggcaaatatactaatgttatatatgtacttctcttgttcagggcagtcacttgttttaagtaacatgtttatctttattaaaatatgaatttcatgcggttttacagcaaggttattggttaaatcaatattctcaattaatgaaactagtgacatcatcatcaagagcaatagctagcatttgttgaatcctgactatgtgtcaggcattattttaatcacttcatatattttaactcatttaatcttcacaatggctctactatatagaaacatgtattaacccaattttgccagagggttgagacacagagattttagggaacttaggcaaagttacatagctagaaattacagtcagtgattgcaaagcttgtgctcttaacttctattttatcttgtatctgtaaagatatttactaaccaagttaagtgtccttagagcatatttttatagtataaaaattgggaaaaaattaagataaagaaaaaaacccataatcctactgctgaatgagagctctgttaacattttgaggtacacatatttaggctttttccctcctttacatacattcacataatttgtattataaatgctcttttaaattaattttattcaattaatatattttaaaactttccccatggtattatttcattattattttaaatggctacattaagatatggatatttaggcttgaaataagtttaaacaaacctattgtcttcttaaatctccagtcatatttccatgaaggatggcagctcttagaagtcatggaagcaaagaacagtacccctcaggaccattgtaagaaaatgtcttctttgagagttcttaagactattagcacatctgaggacattttcctaaggattcatcttggtgtaaggacacactggggatattttaatttgtagtgatttgttgttgttgagcaataaacagtatatacctcttgaatttgctaaggaatgtgtgagcatacagtgctggtaacactacattagttaactctctttacctttcaaaactgatttaatgaaggtattttaatgccgtttcatagataagaaaatgaagtgcaaagtagttaacttgactaacaacaagtaagtgaaggagacataatttaagctttagcacagacaatctgtctcttatagtgaggcagtataacaataaatatgtggaggagatttctaaaatttccagtgtatgttaagaaaacaatgtattttatgatgttttagagaactgcccattataaccaactgataatgaaattcttcatctttccatgctatcatatttttcccttgtcagcacactgacctaggaatcaagaaattttggttctaatactcgcatttccacctttctgggtctcaagtttttatctttaacataaaaggttagaaaacttgaaaatcttaaagtctcttcttggttcagagagattagctttatggagttgtagagcctgtgtagaagctttataaagtggtttagagtcaattgacctcattggagaaaaaaagtagtcagtaagttcttcacctctgcaaagtgcagactgaatgtggagaacagaattgttgttttcttagctgtggctgtagcaggctgttactgattaccctcataagatgttttgaatttgtcttggaggaggtggctttcagcctgactttcaggctggctttgggtcatcctgagtaagaacaagactggtagtatatgctgccaaatgtaaaattatataactgcccaggagagctgtcacacgtggaggatactagaggctgccatgacaatattagccaaaaaatgataaaccacaacgtgatagaaggaagaatcctcactttatagttgagccccgagtaagtgaggaaagttgtgcaagtttgtaacttcagtgtgatggttgaggatggaattaaagtctcctgactgcttatgaaacctcccacctatatgtttttacgcaaaatgtcatggcccttacatccttttgtttccattgctatgatggttctggattgtaatcctataagaatatgatcacttaatgaatttatgttcattatatttcatatgcagcctgaaatgcctctggtttctttattagcaaatcaacagaaaacacttgataaccagattcaagattagacagcaaagatctacagaaacagattaatatcattttatggcatactatgatctttttttagggaattaactaattactgctcaaggaagcatatccaataatatgcgggtaaaaggatataagcaaaaaggtagcagtaaatagctgtgttttggattccacaaggcttgtgttaggtgaggtcttattcagcatagttatgatgtggtaaagagagtacattgcccactaatacacatttcaggcattataaattgggaaacttgcaaatgcaaataagaaaggatgggtaaaatcaatatgcttagtgaagaagggatcttaagaaatttttttagaaaggatatgggaccctaaaactattgaagtaacaagaaattaggacaagaaactaatatgggaccctaaaactattgaagtaacaagaaattaggacaagaaactaacagtgatagaggaagggtactggcttgttagatttgggctcaccgtttggcaatccatctctaaaccctatcacaacttatttataataataatcttggtgctgatcatcataatctgggtatgcagatttacctacataattttaggcaaattggttaacccctctggacatttaattcctcatctgtgaaggagttacacaagaatacatttattggtttaaataactactgttcaatagagaatttttaaattagcatctgtagctctgttaggagggaaaaatgatgatgttttatgatttcaacacatgacttcatttctttgagctatgtgacagtcatgctttcctccattattcatcaatactccccactgcttaaagttgcaaatatctagggctgggctacacaaagggaactgagagatagcccacccttccgtgcaaattttattgataagagtgatgtggtccagagacatgagacaccttgtccaggggtggttaatggtggagcctgaaggatgagcaggtcatgattctcagcacagaactctttttctcttgtagaaaagatagcaaataggctggatgaggtggctcacacctgtaatcccagcactttgggaggctgaggtgggcggatcacttgaggtcaggagttgagaccagcctggccaacatggtgaaaccctgtccctactataatagaaaaattagccaggcatggtggcatgtgcctgtagtcccagctaccgggaaggctgaggcgcaagaatccattgagcctgggaggtggaggttgcagtgagctgagatcacatcactgcactccagctgggtgggagagtgaaactgtgccaaaaaaaaaaaaaaagaaagaaaaaaagaagagatagtgagatagtaaataggttttcctcctcatgccaactcagatcagttgatagtacctgccagttgagaaaatttgtaaggacgtagtacctaggtactacataaaacactattgctattaataaataattatcactatcagtaattattcattagtactgtctgctatattaacaccatagggaaatagaaaatgtttgccacctcctatcaagaatattctttaaacatattccttcaagataaacgttcaatatttattctgcctttcttgtatctctgtcactcacaatattacctaatgctatctaatgtattctgttcttagagaagtaaaatgtctcagtagaccaaacttagatttgatcattacgaaagatgtcattctcagtggctggatcttcatgaggttttcttgagctgtttttcatttcacctgctgctggatgttttaggctgctgtattcacatctggtggcctgtctcactaggatctcatggctgcccgggcagtgtcacagctctgagttcaggttggctctagtcttgcccttcgctacagaatcgtggaatacagtgggagatgaagaaggcagcactcttgccctttgtgtttctagtaacttaaattcaactcctggcagcctacttcacattctgatttgggcttctgatgttgagtgctgagggaagctttctcccactgcttacatgttctagctccttggttggctccaaggagttgtgatggaatttcttggcatacttcaagccagcagcagccaggttggccttttccctccacatcttatagctttgtaggattttgggagaaaactgacctggaactagttacatgacctttttcatttatttgggtcttagtgctcatccttgtcacctcttattatttagaatgaaaagcacattactctttaaggaactagagtataaattcagaaacctagaacacatatattaatacacagaactttttctcttttcctagctgttcaaatgtaatacagttttatgttcaaactaaatgaatgcctatttattcctggaagtaaattttgttattttctagtccaggctctttgttttacacatgacaaaatagaagcccagtacacaggagggttgaatgacttgtttaatggcacatggccaaagaaacagaacagaaaaaaagaaatcagaatttgtcagttttctgtctagtgcattccaaatcacatgacacaaccattattggttttagaattggaaaagtttggtttattttttaactgactactcagattttaaaaaaattgtttcattaatagattagtaaaaatttaatactgctgttcattgtagggcttagtaagccattactatgatagatctttatttttgttttctttaagtctgtactggacattgaagtctctctatggtctctggacttacgtcttggccttacagactgtcctgtttcacctttgcctcagtctttgcagtaatctccctcactgagaagtctggaacatgccacatgttcacagtgaggctgttaaaacttccagccccatccaaaacctagacttggaaaccattgtcgcattgctttctgagtccacagatagcaaatgtgacaagtcaaaaatgatgcctaatgttgagcaaggagtctttaaaaagccctactcatgtttctaattctcacacccatgtaattcacaggcatctgtccacaggtagtttgagaacctaactatattaaatttcaatattcagcaaatagctcataaccaatcatatctgaattagaaaagcatgtgtaaagaacaatagcaccaactagcactcatagcagattattccagctatgttataataaggcccttggcaataactcaaggtctgttttttcaaaatgtaaggattaggtgttcttgaggcaggaaagaaaaacaagactattctttgcagatggagaaaaaaatgaagtagattcactagcagagtcactttcatggaaatttggagctctgctgcacagttttagtgtttaaacaggattggaagtcctttgggatgacattttcaatgctgaaagagaaacacctgatagaattgagtctcaatgaaacagaaaacctgctgaattgaaaaggggcttcactcagtgactaattttctaaagtgagtaccccaaactgttaataactattttaaagcagttggatgactacattcaagataaaaaattatatgggaataaaaattgtcaatatatctgattttggtaaaactaagcacacaatttaaatttatcttggaaaaccttagtagttattggaattacttgagaatctattgcaagcaatctaaatgaattcttccaaaacatgtcactggagcaggtactcaagaagtaatctgaagtaaacaaacaaaaacaaagctatatttatccttcctcttttctgtgtaatataatccatgggaagacaagaagaaatttattttctacttgtgagatttggggatgatgatgctttttctatccttatcaccatttgtcaagatacaactttcattactttccagtaccacctttgaacagcatcttcttttttagtatattctcccttcctccttccatctctccattctttcttccctcctcttttcttcccatatttccttccttccttctttctttcattttctctctctttggaatctcttctcttaactttatgttttccccaagtgatcagctgtttttatacttctctgctggttcctcctaacagagtctttgcagattttaaagtaaaaccataaagaagaaaacataaatagaatcttcagtgatttcacagcagaaaggcatggtttgtattactttctctcagaggtatttttaatggggtaaatatttatttccagatgacccaaatctctttgttatgtttgctgacagaaacagcagctcctccttctttctctctacagtaatgagattatggacagggatagaccttcttcatactgctctgacaacagacattttataaaccagggacgggctatttcaattcagtttaattcaaaaaaataattattggatacttaccacatctaggatattgttagctgttataaatgatacaaagataattaaaacattgttcttcctctcaaggaatttgtaatctagtatgagggaaactgtgtaaataaatatccaatcctggatgactgccacaacataaaaacacacaaatgtttaggaactcggtagacaagcaaaggaagtagaatagtaaagatgaatgtctcctatttgtcaatattttacttcacctctgtgttgttttgggatatatcaaataatgtcttttaaatttagagttattgttactttataataattattattattgtcataggtagtgttaggttgtgtcatttatgtaaatacttatggagtagtaacatgatatagtagtctacctcagaaagagatttattgagtctatgatgctgaattatagttttgtaatatgtttctaaattctttatgatggagtcccactctatcacccaggctggagtgcagcagcacaatctcagctccctgcaacctctgcctcctggattcaagcgattctcctccctcagcctctcaagtagctgagattacagtcatgcgacaccacaggcagctaatttttgtatttttagtagaggtggagtttcaccatgttggccaggctggtctcaaattcctgacctcaagtgatacgcctgccttagcctcccaaagtgctgggattacaggtatgagccacggtgcccagcctgtaatatatttcattccaacttttagatagcttctttatcaggtgctgcaataaattgtttgccctagatcgaggtggggagagagccctcttaggatgagctgtcacacagtaaaagataagatttcctggatcagttttctaaagtgacaggcgtgtcccctaatcgagacagacagtgctccattttgacaaataggccagacttctacgtgtgcatatttgttttgtgtgtgtcagagtgagggtgaggttgaggagtcattctgttcttattggaagtgaatcaggcataaaagtgatagagcgcttgaatgagatgattgcagttgaaagacacagcaattaagcagatttcagactttagagagcatgtcttccgggagctatccacggtactgaactgcttctccctatattgtcctgtaaccccgcaaaacaaaccttcaaacattttaaaaccacaagacattttaaaaactggctttggttattccttactagacaaattctctaacctgtgtatttctaatacttgttatttgtttaatcttggctaggtcagcccatttttttttgtttgatattacacattcatccatttatttattcaacaaatatgtaggtacaatcttccgtatgttgggcagcctcctagtggttaaggtgcttaggtttcttattatgtaatgctaattattattacttttgatttttctgggatttactctaaggaagcagatttaatgattaaaataattctacttcgtgtgtgttgtttgaagaacttggtttctggcccaaagatgatgctttgtttacagtacctagaacagccctttggcgtatcgtagacactcaagaaattgtattcacagcataaacatgtttattgttgtggagtgattttctatgaaatgttacaaggaaaatatatattttaaaccaacaagtaatctttgcaaaaaaaattttgaataagaaaaatattgttctaagtaatctagatggagcatacacctagccttaaagagtctagaattgacatgttgggacattctcatatgttaagaccacattacaggttgaccagaaaactaggaagaaatagaccagatacttcctgctcaggcttttatgtgcatatagaagctcagtgatctttttattctgttttactcaggctattctgtattcaggtaggatatctatcacccttactcttctctaaccccatcttaaaaaacaaagcggcggggagtttttcttttgatatcagcaacagataaccaaataagatggcgtataatcttttttttttttttttttttttttttttttttttttgagatggagtctcgctctgtcaccgaggctggagtgtggtggcactatctcagctcactgcaagctccgcctcctgggtccacaccattctcccgccttagcctcccaagtagctgggacgacaggctcccgccaccacaccaggctaattttgtttctgtatttttagtagagatgggggtttcaccgtgttagccaggatggtcttgatctcctgaccctgtgatctgcctgcctcagcctcccaaagtactgggattacaggcgtgagccactgcgcccggccagaaggtggagtgctattcttaactgtccttttgtagttctttgttctaagaatttggaaagacaagttagtcctgacttccatggaaatgttttttttccaaccaacatgggtgtaattctgaaggagaattctttcttaccagtgactcagtccctctgcagggcacagaatcaacagtattcctagtgtttgcaagatcagtgattatatagggtcagtataggcaaactctccatttccaatccgttgttaatgaaatgttatttttggtgaagttctgagatagactgaatctgagcagaataaaaaaaagtggaatcagcctgagttctagcttctacccctatttctgtgatatgcttccttattgacatgtgggctttgaaacttggtaacatccaaattgtattatcactctcttgaaaatgtcattgttccatgaaattgtgagacttaaccatttttattgatatctcagagaaaccaaatcttgagaactaagagcattggaggataagctcctttcctagagatacttactctacttttggtcatggaccaaatttggagttattcctgtggatttttttctcttgttccttaaggcagtgatagatgcttgtttagtcaccataagttgtgagaatatgtggtctcaataaagacccagcaataccttgtttttctactcattatccagccccaaagtttaagatctaaatgtttcctggtgagaatacaaagaaaagtgagctcttatagcctgttgatgggaatgtaaattagtgcagccattatggaaaatagtagagaggcttctcaaaaggctaaaaatagaactaccatatgatccaacaattgcactattgggtatttatccaaaggaaacaaattcaggatattgaagagatgtctcctatttattacagcactattatttatttatttattgcagcactgtatatttatttattgcagcactatttatttattgttaacactatttatggcagcactattcacaatagccaagatatagaatccacctaggtgtgcaagcatgaatgaataaagaaaatgtatgtatacagaatggcttactattcagccaccaaaaggaatgaaattctgtcattcacagcaatatggatgagtctggagggtatcatgttaagtgaaataagtagggcatagaaggataaatactgcatgtccttacttatatgtgagagctaacaaaagttgagctcatagtagtagagagtagaattgtggttattagaggctgtgagggggagggggaagaaaggagagggaacggttggttaaggaaaggagaggagaggttaagaggttggtgcagggttatagctgggcaagaagaatactttctagtgttatgtggcactgtagggttaaatacagctggagatgatttatttatattttcaaagatctgggggagaaggttttcaatattcgcaacacagagaaatgatgaatgtttgaggtgatagatacggtgattaccctgatttgatcattatgcattacatacatgtattgaaatatcactctgtatactataagtatgaataattatcatgtgtcaactaaaaataagagggaaaagtttcaaaacaatatctatttgttgattccatctgtatggcttagtgataatgtaatcttttgctgtcttgcattgttcccatactggatttcatgactaatatctttgcctttgactgatttgaataaaaatatgttaaatgaacagagaatcttgacctcctttcagaggctgaaggattccttaatttctttcctccatttgcttaggaatcagtgccattgactgtttgcttttagttaatacggttttgtttgcttaatacagaatatgtgcaatttaagtgtcatatgtacataataagatgtaatcttttaattatatgatatagcataattatttccattttatatatgacaaagttaatgtttaagaaagttaaataactctaattaggagtcaggattgagaatccagacacagatggctctgacatcagaatcactgctttaaaccactcttcttttctgcttgctttaatattcctttacttcctccataaagtgccacatcagaatatagaacaggttattaatggaagaaatatttcaatattttgagttttttgggtgaatgaaaattatagaattaaaagctgaacatcattttatttggcagtttcatcattatgatttaaaataaatgcagtttttgaagtttcctaatttattctcttgaaatatatttggattgccacatgctgtatattctaacacttggccctggtagggtttatttgtatatgtgtgggtgtactttaaatataaagatctcactgattttaacacacattggaaatatgcataggcaaaccccaaacaactttttattcaatagtgtccatgtatctctaaacttttgatagaaatttgttccaataatggggttactacataagttgaagaaagtcaaactgaagcaaaatttgaaggcttctatattaatgatcagttttaggcgatacttgccaaaatctagttcaggattagaataggctgtgttgacattttaagtgagacatatcagttactctttttcagaaagttaaaataaattctcataatgaaaaaataaatgataattttagattcttttagagaatttactacctttacaaattaggaaaataatattcacagtatccatgattccaaccagttaacatgttggtatatttctttcagttatacacatacacataattaacatataattatatgaatttatatataattttgcattctaactttctatttgacataataacagtcttattttgcacttttatgattttccaatgagatatatctattagccatttctattttttgagttgcctgtttttttgtgtatgcatagatatatgtacgcctgtatatatacacgtatgcatacatatatatgttttttgttttataaaaagagataccatatttctattaataccgtcacagctctgatccttctttctattgtagagcttctatgcatgtattaaaatttaatttagaaccaatcaaggaagaggtcaatctgaataagataatatttgtaaagttcttgcctgtattatgtatagcaactagagctactttatccacagcgatttgaagccatgttgaacctatacaggttaattgatgcaattctcttggaaacatcgtcatctgttggcctataatgttttaaaaaccttggaacagtctcattgttttaagtatatctcctagttttttcctttaatttgtttgatgatatttttattttcttaagatcatcttcagctgaatcctgacaaccctactacatgatcataacaaaaaaagcaatgaggagtctctataccctttattttcataggaaaatattctaatatccacaaatgtgattaaaggatagagcaggtggtggggcgaggtaacatctgatgtgagaacgaagaagcaaacagttgttatttttactctggtcaggtgaaaacaagcagtcattacatgtctaaatcttgggtatctttggaatcattttcagccaccgtagtaagttgtacgtgcttgagtgtttttaaagcatgtcttatagtgaccaaatgtttctaccgcatttatctcagtaaagttgacaggattctattaggacgatcttcacctaatgagataaatattctaattgtaatcatcctcttggaatgcatatctcttctgggaattaaaagtgctttaagtggtgttgctaaacaaacatttctaaagagtaatcataaagttaaatgcctcacaatagcacaataggctttttagttgacctggtttttaatacttttttcattgcaaaatttcttattctggaaagtttggaaaaatgaggaaaaaaatagaaagaaaaatgtcgaatttaaacattttgtcactacctagttaaaatcggggataacattgtgatttagatttctccagtctcctttctttttttttttttttttttttgagatggagtctcgctccatctcccaggctggagtgcagtggtgcgatctcggttcactgcaagctccaccttccaggttcacgccattcacctgcctcagcctcccaagtagctgggactacaggcacctgacaccacgcccgccaatttttttgtattttttttttttagtagagacggggtttcaccgtgttagccaggatggtctcgatctcctgacctcgtgatccacctgcctcggcctcccaaagtgctggggttacaagtgtgagccaccgttcccggcctctccagtgtcctatctcaattcttattcaattgtttgttaactagattggaatcatactgtgcatattgttttataatttgctgttttggctgacatttggaaaaattattttagaaaaaacagccagttttgtagatgaaatggtgttttgtttctattgatttttgatttttaagttgctattacttcatgaagttagcgtctttcttgtgtattggctattctcttttcttttgctataaattgtctgctacatcttttagttcataataattattgagtcattttctgtttaaatataaagtatttttctcatttgtcgctgtaacataatccatttttaagaagcagagcattttcttgacagagttttgaaatattgtgtgactttatggctagaacacagaaacattagttagaatttcagaatcatttgatcagctctggctttgagcctctgattctacttgtagtctccaaaccaatctttggtatccttctgtagagatgtaagttgttatcaccaactcaacatgaaattgtaagaatttataacagtgttttctaaaatgatttctttgatttattcaaagaaatattatctctgataatatatttcagtatttttcatattgctcaatatcagacgaaagttcttataaaagtcctgattgtttcagcagtgatttgcatgccattagcaggtcattcatccccttccactttgaggctcaagttctacactagatttgatttgttggagggagtctacaaactctgctttcactagaaagacatgatctgtgtgctttgctgccatagtgggcctatccacatggctcattctctgtaacactaacttccaggaaagctcttgtatcaaaattcatcaccggtattaaacagtgtcaattatttttatcacctgttgaaagcttaaatgccaacagaaatttgtgcttcacagggcattgggtcctccatttatatttttcaaatgtgtagtatactcttgcttttagtcgtctattacccagtgttcttttcggaaaatatttttaaagttaattatatactcacagataatagtgcaagcaagtttcctccatgttctgctttcctttttctgactttacttcatgctacattccttcacaaatagtaataagaatttatttctactcagaatgaatgttcctcacagtggagagaatttgccactacaaaatgccttctactctgtgtttaaattcctcgtacatacaagcaggttttgggtgttacatttgttcatagaggtatgaaattgagagtcatagattgaaatgttttttatagtagagactcccaaaaaaaggcacagaaaaatggttgatatctagtaggagttatttacatgctgctatttctgatgcttcctatttgtttcttctgaaaaagtcgcccttcctatgtctcaaaacagtacacctgtaaaaccacatcctactgggcataattctacaactgcttctattctcaatgcttgtgttgcatgcttttggaccctaagagaaatcagcaagctataaacccaggaccaagaagagcatatatctcttggaaaaatagcatttgagtgattgaataaaacaggctgttttggggatcattccaaatgcagggaacaatatggatctgtgatacttgagttgttggactttgtagaatatcaaagatgttctgcttttcatattcagatttttaaatagaaggaaataaacaatttttaaaatgtttggaattaaatgggggaggtcatctgtaactgtctttgttgatttttgtgggcatcatagcacagaagagttctcctggcttagcattctggtattgctcacatatcacctatatgctaatttgagagcgttcatgagtgccatgaaggatgagtcagaatgatagacagtatgctgactttttctcctcttattgaatttagtctgatctgctagtgagagaaataaaagggaaataaagcagggagtataatagggaaacctattttctccaaatgttgagatatttaaaaagtctttgttcagtgtacctgcagttataatctttccagagattcatgagatgtcagggctaggcaagactttagaattctatgtagtaaactcttgtttggggctgggaaaatggagggtcacagttagaataattgcctaaagccacaccgacagagagctggtagtggaatccctgttttctattcaccttcctactcagttgcactacaagtttatcctaattcaagtaagcttagacatcaccttgggtaactttctgatttaccaaatccactagtggaccatattgaatttgcttccaacatgaatactcttcatttctctccatccacactgctacccaccaaaatcccatgccttgaatgtaaataatcttagagctgatctgtttgcttctgtaacttcctgctactcattccataagcaacagaagaggcaaaatgaccttttaaaaagtataatttgatcattattctcctttacttaaaatcctagaatgacttccattgcacttaaaattccaaatttctttccatggcctaaagggtctacttgatcagtgtatcgcctttctctagaacttaatctacctctgacccttgtgtgctatgctgcagccactttggcctcctttcttttccccaaaattgaagacacatttccatctcagggcctaagtgtttgcagttagctctgtttggtgttctcttctcctagctgtttacagctttcagccttctgcagagatgttccccagctaccctgccgaatatcgcctttccccacccaatcctttcattaccctattttttcatagcagtaactactaattaattatgtctttatctattgtcttttcccagtctccaactagattgcaaagtccctgagggcagaggtcttgatgtcttttccattaacaatatctcgagtaaccaccagcaatctgcacatagtaataacctgaatattcctttaatgaatgaataaactgaaaaccctaaagttcagtaatactggcctctgtgtagagtttcagaaatatgccaaatatgctttcaagcatcccagcctgtctagtgtatcctttgctctcttggccttctgagatcacttttaattggcatcctctgaagttgttactctcagtcatgctggttgataccccgaatggataggaaatggataggcattttttctgtccatctctaaacatctctgattgggcctaatatacctctcaggcctgctcctctggccaggacccctctttttatgggaagtagggagacccaggaacacagaacctataatatattagaacctgttatatatctctctagaaaaaacagttattttaaggaacgtgattgctggggatggcaagtcagaagcctgtagggggaggcctgcaggctggaaactcaggtagcagttgatgctgctgttttgaagctgacttttttcttctatggaaagcctcagttattgctcttaaggcctgccaagcaatcggatgaggcacacccacattgaagattatctcctttacttgtggtcaactgattatagatgctaaccacatctaaaaaatgccttcatagcaacaccttgattagtgtatgattaaataatgggacatgatagcctagccaagttgatagaaaactacccatcccatcatgcatttgtggtattggagaaaggaaatgcttctccattgttactactgggactgttactgctgagacacaccgaagaggagaatttttagtttttagtttgctttttagcagaattcaaacttaaatataaaattaaccaaattgtcagaaaggactgaaggttatcctttcaattctgagttttttatgtaaaattattttattattagcaacaggttttgaaaacatttatcaattatattcttatatattggtgactttaggtaatgaataaatctggatttatctttctttataataaaaatatggtctgatcaaagtatataaaattgaaataaatattgtcttatttgtgctttaaattaattgtagtataatattaataggatattatataatattcagtcattttagaataggagaaacattttagggtaggataaacaagaccgtatcatgaaattggagattttaattgttttgtaatattaaattttacctctcatgaaaatagagtagataattattatggattatgaaacagcataattagttgtaacagttttaccttgaagaaaatatatcttttttataagcagaaaacttcattttgttttctttaaaatgaagtgaataccggccgggcgcggtggctcacgtctgtaatcccagcactttgggaggccgaggtgggcagatcatgaggtcaggagatggagaccatcctggcttacacggtgaaacgccgtgtctactaaaaatacaaaaagttagccaggtgtggtggcgggtgcctgtagtcccagccactcgggagtctgaggcaggagaatggcatgaaccctggaggcggagcttgcagtgagccgagattgcgccagggcactccagcctgggcaaccgagcgggactccgtctcaaaaaaaaaaaaaaaaaaagatgaagcgaataccatctctactctcaatgtatcgtggacgataataactatgctagtatttctgcatagtattcttaaagaattctgactgaaaatatttaaatgaaatacacataatcactttgccacctaatgcccatcaatcattgccaacattgacttttaataaagacacataaccagagatgatttttaaaaattatggataaattacattagaaaatttagctggagcaaattatatttgattattattaacctgccataatttatattcattaaattgccaaatcttgattataatagtcaaaaagaaaaggtacatgataatgatctagaggtagaacacatgctatcaactggaaaactaattgttcagcatcctaagtgtatttgttgcttaattatatatataatttctacaacaagtggaatgatttacatgaatgtcaaataactggtttataaatgaaacctgatattaagctaaataaaatattggcatatagtgttcacttatgagctaatattcttacctctagcttcatttacaaattaattatgctacaaatatattaatgttccacaactctttcacacttccatcaatatcgagtttattccattacaatgtgaaattaaaaaaaactgtagaataattacttctgcttcagaaaatatagattacctatcttccagtaagatgctgcaatttatttagataactgcatttattgcattgattttgaaaaattgctcaacctaataccctttcttctttgctaattcctggggaaaaggaatccttttcattttgatccaaatgaccattaatcatattataaagtgtaataattaaccctttttttaagtgtcagagacacatgaatagtgattttatttggtttcaataatcaagtaaattaagtgataaaatggaggccataattaagtgatcttgttttctaataagaccaacccattaatgtgcatgtaaagatgcctgtcatcaatttaacagctttctgagtttaatatacattaagagttttatttttggaacaacttagtaatttttagaaacttgagtacaagtgttggcaaaggttctataaaattctgtctacagaatatgtggaacacaaccttgggtcgtatctccaaggaaaactaccatgattaaaaagacaatgctttgtcaaattcacttgttatcacaatctaattgtgttaaatgccggccacattctgagtagacactttaacttggcttcccttgggaaataggaaatgaagggcccgaaagaactagaagctgcctctcaattttctttcaacatggcaaaagcatttgcatttatctgtgcccctctcttggctacactctcagctttgatacactacttgagcatgtggaggtttacctactgaatgtgacccttatatgaataatatgagacttttgtatcaacagtagtgatggtttttgtttttaagtcacattttattgtatgtcttctctacctctcactatatgacaagtttagtgaaggcagggtctgtggctatcttgtttattattgttttatatcctgggggtatcacagtgcttgatcatagaaagggctcactaaatatttatggaaggaaagagaggaaagaagggagagtgaaagaaaaaacattcaatgttctcactcttaaaccaagaaaataattgtttactttatttcattgtagtaagaaaactgaacatgctactaccttcaataaatttttaagtctgcaatacagtattgttgaccataggaacaatattgtatagtggatttctagcatttgtctttcttaactgtaattttgtgcccgttgtttagtaactctaaattttcctcttcactcagaccctggcttccccccattccacaatttgattctgtgaatttgaatattttcatagaaaacattttatgagtagaattatgcagtatttgtttttctgtgactaacttatttcacttagcacaatgacctccaggttcatccatgttgttgtatatttcagaatttccttcttttttaaggctcaagagtattcgcgtgtgtgtgtgtgtgtgtgtgtgtgtgtatcacattttctttattcatctgttgatgaacatttagtttttttcacagtcttggctattgtgaatactgctgcaatggacatggatttttaagcgataaagaataaagctcttttcatcttttaactggaattattttttagaaaatattttgttccaattttatgatttttttgctattctttcatgattaaaagttatgtttcattattatcaggttgtatatttacatatatattttgtctgatgttaataatggcatgtttactttctttgtgtaagctgatgtatggaaaatattttcctagcttttatttcacattatttcatcttttgtttcaatcattcatcttgtatattttggcttccttcttcccttttactcaacttagaattttagagtgagtaacttttaagataaaacgagtttaacagataatttagcccattcacatttgttgtaattcatgatatttgtgtgtgtttgttatctcttcatttttgaattattttgctttttaatacatcttttctccatttcttctgcattaccttccttctttattattaattgaggttttttgtgctgttcttcttccatcttttttaaactaatgaattacaaaatttgcttctttttatgatttgtctcatagttattgttaaagttttgagacctgtgagtaaaaatattttatattaatacctagacttataaatcagtactaatatcttgtcttgaacaggacttcatccctagaatactttttatttctacatcatctgcttttaaataatcagatattaaatccagattgccatcgtttcatttttaaactttgcagcagagatttttttagatgtgaacataaggtgtctattttctttgcttcttgttattttgtgttgtctttctctttcttgggtaattttttgttttgttttgttgaatcagtaagcttttcagaaaatgcctgtaggtgttaaatttctgagcagttatatatctgaaaatatctttgctcttacatttggttaatactttggctagatttagaatttaaaattatgaaatgtttttctacagacttgtgaagacattcaatatttgtttcagcacatggccttagaaatgggatatctataccaatctaattcccatgtttctgtaagtaatatacctgtttttatcttctctgagatattttggaatttgctcattattcttggagttttgaaatgtcatcaaaatatgtctaagtgctggtcttgtttagtaatcttgtatacctcaggggaaatttcagtctaaagatgtatatcttttccttcagttttttttttctctctctctctccatatatatatatacacacacacacatatatatacacgtatatatacgtgtatatatatgtgtgtgtgtgtatatatatatactttttatgtcttattagacaaacgttaggatttctgtttctgttctctgtcttaacttttttatgctctccaggccatcatgtgcttgtcctataatctggaccaaacccaaggtacacatttgtagctcacaaattcttcactagtcaccatctctgacttatcctaaatgaaattttattttatttttaaagtgattatattttaaatgtttctttttataaaatgccaaccagtttttcttaatggctgtaatgtattgaatcccttaagctagttcattattcctatttcaagatttttttctactccttctattaattgtttttttttttttttttttttgagaactagttttgtgttgtttgcattggagtagcatatacaagccattgtttctgacccgagtgctctcttttagaattttttttttttttagggtcagatcccctcatctagtacctctgcctttaaccgcagtctcatgaatccaactgctattcagcaccttcgactcagatgtctgataggcctgtcaatcttgggagacccctagctgaacttccacagaaggatgggtctgctccttccctagtctccccatatcaggagatgatggtacccttcaccctgtagctcatgccaaccttggattcatcctgatacctttcttgtcctacattctacatccaatgtatgaacttgtgctcacttttatgtccaccttcaaacaaataccatatctgactgtctctcaccactccccagctacatccctaatccaagtcaccatcatctttcacttactctattgcagcagcaatagaccaatctgggctctgcttccattcttttcaccctatgtttattatgtattcagcggcctcagagaaatgtaaaacataaatcaagttccatcactccctgcaaacaacaacaataacaccccttataatggctttaagtcctaagcatgaccaatacagccatatgacatcaaggtcctgcttacttctctgactttctgttctataatttctataatgtctatcattgttcactgtgtttcagtcatattggtcttcttgctattttggggagtatgttcccacctcagggcctttgcacagctgtttcctcacctagtagctctttctctagatattacttggcttcctccctccctttaattgtttctcacacaaaatgcacctcctcagaaaaggattgctctcatccagttatcatccactgtccctctttatcccttttccctgccctttttcttaataacatgtaacgctgcctggtgtgaccaagataggtttgtttgtgtttgttgttgttcttcaaaatagaaacatgaccagggtatgggactgatgacttctccaccagcatatcctctgagggtgctgaatcatttctgttacatagtgggtgcagaggaaatatttgttacatgaggctatatatcaaagggcttcatgaaggttttgctttactgtgaatctggagtcagataattcttttctttatttctcctctgttttctttgtagagatcatgaatatcttaagctttatggtgcctctctctctatagtttggctatgagcctccccgaggcagatggttaactttatttagaaagagggtttcaggactttattctagtgataaataccgtggctgctagtcatagaataaacaagggcatgagagaaggcagccaactagaccagctgttcacaccatggtcctttcataattatcctggttactgcctcttggctgtgtgtattgcttgactccaagtgtggggtgtcttttgtagagctttatctggagctgttttagggagaatcaatctcacttctagtagatttctcctgtgtaagtgtgggctttgatttcctctacttctatttctactaagcccattacttatattaatcccatctactttcaaccttcaaggacttttatttttcaaatttctgatctgatagttaaaattttccccgatgtgccatgcacttattctaaaatatgatttttttcctggtgtcaataagatttggcgtacagggaaagacagatatatatgacttaaattttgtcttctttgcctctattgtatgttactgtttttatcttctgtgttgttgttgttgcttaacaaatgtagctacacatttatatcttatcactgttttcttaaaaataatttgttttgttcttctcccttttatatttagaaaatatataaaaaatgtggaccatgcctttgatcagaaattattatgaaaattgttgtttagaatgggtttgagggtggaaaagtttattaagagattgtaatttaacgaaagagaggtatgaatattctgagaattgaggtgtcttatgcattaattggattgctagatggccccactgatttcctgtttttcttgttgtgttaatctatatattgaattaagcacctcaaactatgagttattagatctcatatatctatatccctacagcaatttctctaagctctggtcatttctgctactttgtaatctaaaactgcttcataacttcctagatagaaatagaatatgtgggtgctcagagtatcagatagaccccatatataatagctatgaaatttcaggctctataatggattataggatatttttgaaccttggtaggttgtaggattagttgcttaaatacatagtaccatagattgcaaatgtttaaaaatcttgatgctggaatttattagaaaaacaggaatgaatacagtttgagaggctagaaccgtggatttcaaatgctagcctgtatgagggtcccttggagggcttcttaaaatacaagttgctggttgtcattttcagggtttctgatttacgaagtataggatgggcctgagaatttgcatttccattaaattcccaggtgatgtggctgctgctcctgggacaacatttagagaaccgctagattagacagtctcacaacagggatttctagggacagcttaatggttactttatgatttgaagctggaatacccaattaggggtttttccagtctcatttcatttcatttcatttgcttccttttttctttcttccttcctccttcccttcctcctccccttcctcctccttccttttttatctcctctccttgcccatcccctttcctcccttcccatcccctcccatctcttccccttccctcccctcccctcgctgctcctctcttctcctctttctttctttgccatttcaggtgctttatctcttaagcactgcactgctttgggttatccatttaagcttagaaggagagcaacagaaaaggaattgaaatgtaaagcagatatcaagagagcaaaatttgtcattaaattggaactagcaattaatttgtctatttattcatagtctaagtgtgattatcaaaaatgcttgagaatcaatagaaccacatgggtttttcaagttggataggaccactgaagctacctggtggaaacacatcattgtattgatgagaagactgaagcaagaatatgaaaagcatctgaaccaatgttttcttttccacgttctcatcactctctgctacccacagctgcccgtcatggatatactatatgttgtcagctatattttgattacttctctgtatatttatcatcatagtttactaaaattgttagtattataccttttgcatataagaaaggatgaacatttctagttcttaaaatgtaagaataagtgattacatattaccttgaaacagtatggaacactttttactttaaaatatttttttcaatttttgtgggtacatagtaggtgtatgtatgtatggggtacatgtgatactttggtgcaggcatgcactacataataatcattttccagaaaattgggtatcagttgcctcaagcatttatcctttcaattaatgctcttagtctgttggtattaaaacaatttttattttctgatgagaaagttgctgtcactttgatcattgactttgctacaggaattttcttttcttttcttttcttttctttttttttttttttttgttttttgagacaggtctccctctgtcttccaggctggagagcagtggcacaatcatggcttactgcaatctcaacctcctgggatcaagtgactcccctgcctcaaccccctgaccctcactatctgggactacaggtgcacaccaccacgcctggctaaattttgtattttttgtcaagacaaggtttgtcatgttgtccaggctggtctcgaactcctcggctcaagtgatccacctgccttggcctcccagagtgcggggattataggtgtgagccatcatgcctggccaggaattttcttgaatgcttcaataactttattccatttaactctcacaacaatcccatcaaatcaagtatcatgattatgcctcatcattcatttcacaaattaataagcaaagtcttagggggttatcacttcccaaattattacatgccagtgaaaaaccaaagtttgagcttgcacacaaactttgaaacactattcaaaagcagtgttttcagcacctgatctttattgcctcacagagttttatacagatacaaaattatgaaatgtagctggagccaggaactatgacatggaatatacctggcatacacatggtctttgtcttttcctacatctgtgaacttgttgaagctttagatgtcttcccagctcagtgatcatgaagacgtcctcactgatgagtcatctttacttgtcatctctagctacctggaataaaacacccagtgtagtgtctgggatccagtgggcatcgtgggtcagttagttctccagccccggttccttttctggttgcctgagcttggaaaattcataaaatctctttggacctcagttacgcaactgtgaaattgtgctatagggtgacttgaaaccactttgtagattttttgggagagctaaattaggtaatgcatgtaaaagcatttagtgcaaggtctggcacataggatatatttgctaaatattcgtagaatcagatgaataactctcatgaaatattttgttaaacattgtgattgttcactgggaatattatatggctgtgtgtgccactgtccgtgtttcccctaataattaataaatattaaataatttaaaattaaatattaaataatttaaaattaaatattaaataattaataataaatattaataaatacctttggcaagtatatactatgtcttcaaaatgtttcttttccatttaatgttttcatttatctgcaacatttcttaaggcttatttgcatgtgggtaaaattcaggctacaataatagtcaaggaagtatatttctcttgttctgctcccatacaaatggtgcccccctgcaagcctcttctgaattattcctggacacccaaataaaaatggtaatttttctttccttttctcctggattcttattctaacatctgctaggaggatccacaccctgtcctaggctagtagtgtacagaccatggttttgatgtctgtgcaaaaggtacaggtttgtttgcatctcttcaatttttttcattgtatgaaaatataaataatataaaatgtactatttttaagtatacgattcactggtattaaatgcatctataatgttgtggaactatcaccagaatccattgccatagctcctttaatcttacaaaactgaaaagttgaactctttacccattaagcaataactccccattccccctcacttaagccccgggcaccactattctactgtctgtttttatgattttggctattcaaagtacttcatataagcggtatcatgcagtggtatctcatctttttgagactggcttatttcacttagcataatatcctcaaggttcatccatgttatagcatatttcagggtatttttcctttttaagactgaataatcatccatttatagatataccacattttgcttatccattcatccagccacgggtacttgggttgcttccactttttatctatcatgaataatgctataaacatgaatgtacagatatctctttgagtccctgctttcggttcttatgggtatataccccgaagtagattgctgcatcatataataattctgtgtttaaatttttgaggaatcaccatactgttttccacagcatctgtaccattttgcattcccaccaacaatatacaaatgttccaattcttcgcattctcgccaaaatttgttacatgttgttgcaaaagtaattgtggtttttgccattaaaagtagttacttttgcaccagcctagtatttttttttctgagtttttttttcttttgttagtaatgggtgtgagtggtatctcataatttttatttgtatttctatagttgttattgatgttaagcatcttttcatgtgcttaccagtcatttctgtatctcctttggagaagtatctgtgtattcagcgtttgcttattttcacattgaattatcagtattttttgttgttgaattttaggagttctctatatattctggatattaatttattgtcaggtacagatttggctttgatggcactaaagctacttcttcttaccttcgaagtcacagtacctgtaatgattgcttatgtttagcaaattaacatcattaggctttctctgtcattatataaccccttcatcctaagactcacacatgagcacctcaactgaggctggggatgtgtgtccctgttgttgggggaacacatgtccttagctctgactccctttctccagggtcatttctatcctctcttccgatgacggtctaccccacagatcctaagccacatccaagtcacctgaattccagcatgattcttacttagattcttaagtttaaatgcttgtaattccttcttcctttcctctccttattaagtacctttaaggaagtagaaaactctcaacatttagaaacacttacaagcatatgaatttccatattattaatgcctcgtgaccaagatgtcctgacacatttatatggtcctgtaaaagttttataaataatctggagcatattatttctttatatcctcactttgtgaactagacaaggtagatattaaaattccaagtctcaggaagtttgaatgatttttcttaagcttagtcagctaattaggagcagaatcaggactggaatttagggcttctggctccactttatctctgaggcttgtactattctactgggatatcattagaagaaatgccaaatgaatgccattgcctcttcagccctaaacacaaagcccagttaagtgtttccctgacatttttcctgacatctataaaaattcatattttatttttattcacatgctgattgatttagatgttatgaaaattaaataagttccaaaaggcagaagataggctatacacatatttttaaaaatttgtcattgttcaaacaatattgaatataaaattgaaatgtccctcattataaaaaaaaattctctaagagtgactagttataaggttatatcttttggcatgatgcacctctaagcagtgcttgcataaagtctctaccaaagctgacagagcttccctaaggcctaaagaacttggcaaatgttgttgaacaaaaatgacaacaatgaaactgtgtaggaggattctgcattagtgcacctaagaatgttctcgctaatttgagcacttctcaccatggaataatgcttttgttcctctctgtctttttctgctgtctcacagagactcctaacagggctccctggaccaggcttagacatcaatagggatggactagaggcattccatggaggtgacaattacagaagatcagaagtgcctagctacacactctattttcttctagcatctgaaattattgacttgaacccatttgtggggtcactaagccaccttcatataatatttattacatgtgcaaagtcagaacatatggagagcatttgcatttgaatgggggaaacatgctgttagataaattagaaaatctttatatttgcatttttctttatttaaaaaaatcaatctgtggtatagtagagctaggaatattccctttttggttgacttcttcactctgtgtttaaactttctcagcattgaggcatgtgattaaaaggagctattttcctaatacaaacaaaagcattgaacatcctgtgaaacaaaagttgttcattttaacttgcgttatatggaaatgtgacatgttttagatttgtgtaagctcatgtacttgaaaatcagacttgtctaaaatttcttttgtaagatattagagaacttttgaattatacctcttatttttgaatgtacattcctcagagaatcatctttatgcacaaataatgtttattttatatttttaatctactttagcagacccacctgattcttctacatgtaaggttgaaacagttttgagtgataaagaactgattttatggagcaactaatgattttgctgttgctacttttgtgccagcaaatacgtaatccacaagaatgttataagaaagatatttatcaagcctctaaaaaaaaagaaagtaatcaaaagataaggatgcataaatatcttaagactactcatgacatcaaggaaggtgaatcagtattaataattcactagtttgtgcatacttattgtcaggtgctgggtcaaattaaattggaatgatttgttgacatgaggatttctgggttcatgatggattcacattaaaacaatttttatgttttaagccttctcccatcaaataggttttacggtcttgtgtacacattacatgagggaaatagtactttaacattttacatgctggtgtatagtctatatcagcagtccccaacctttttggcaccaggaaccagtatcatggaaggtaattttgccatggagtggggttggggaaaggagatggtttagggatgaaaccgttccacctcagatatcaggcattacattctcataagaagcatgcaacctagatccctcaaatgtgcagttcacaatagggttcgtgctcctatgagaatctaatgctgccactgatttaacaggctgcggagctcaggaggtaatactcgctcacctgctgctcacctcctgctgtgtggcccggtccctaacaagaccattcaccggtaccagtcagtaagctgggagttggggacccgtgttccacatgttataaaaacttaggctgggcgcggtggctcacgcctgtaatcccagcactttgggaggtcgaggggggcagatcacgaggtcaggatatcgagaccatcctggctaacacggtgaaaccctgtctctactaaaaatacaaaaaaatagccgggcgtggtgggcgcctgtagtcccagctactcgggaggctgaggcgagagaatcacttgaactcgggaggcggaggttgcagtgagccgagatcgcgccactgcactccagcccgggcgacagagtgagacttcttctcaaaaacaaaacaaaacaaaaacttaaagagttatttgagccggacacagttgcatagacctgtagtccccagctacttggtgggctgaggcaggaggattgtttgagtccaggagttcgaggttgcagcgagctatgattgtgctacttacactccagcctgggtgacagagcaagtccctgcctctaaaaataaaataaattcggaaagaattatttggtgattcaagtataaaacaaaatctatcagatatttgtgaaaaacatattgttacattgttacatgttttaagaagggaattaaactcctagactctgtatggtataggagttcaacactataggttggtctatacatctaatgttggatatgtattttgtgccttttatttaaaataacatacattttatggcatttcttgctttgcattaattactggccatacccagaatcctttccttcgaataaaataacctcttttcccaaacttttacatattgttcatattttcaaccccctacacagttgttaggtcttgaatttggaagaattaaagggaataacattaatgacagtgaactatgaattaggaacctcaccctatcaatagccaatttccctccttttcagttttgtgtctcagtaatagtccttaaaacaacaaatgatacattaagtgacctgagccaatttcctcttgacatggaactattcaacaaagcctcacataagctaacatttcctaattagccccttaactgttgacttgagaaagggtttgcaatacaggattcttatatattaataaaaactataggtaaaaaattcaagatgttgttgaatctttacagttcgactcattattcaaattcttcatctttacatcaagtttctcatctttacattcctctaattcaggtcatctccacaatatgtccaataaaccgtatttgcaagatatcgggagaaaagcgagtctgcctctaggaattataactgatacttcctttgtgtgatgaacagtgatttttatgtatttagtcatatgctattagggaatagatatctctagatcagagaacagattgtgtattagtcacagaacatcttagcactagttcctccagccctagttcctgtggagtaacgcgatgagggccagatatctatccccatgggcagcagtgttgcaccgcatgagaggaaccctggaattatgaaacttggagcttacacagggcagctgggcacatctgcccttcctcccctccagagatagaaagacttgtatgtattctggcatgtaagcaaatgactctcggggagagtaaaaagatgcctccaggttttatttcatgagcatatggctccagaggagacgcatctctaaacctctcaggaacagttcattgtcttttacttctgagacatactgtccattcagtcattctttagccaaggttgccagtactctttgctaagaaaccccagatcatgcagaaatgtgaacatgttcacagagaattgtctctcaatcaatagtacctagtacattattatacaaagttctggggatgtttggcagggattgaacccatgaactagaattatgagcattggaacttatctaaaccaattagcaaataaaaaagttacacatttcttgagaaaataattttatagattaataattacatgtaggatatgcatatctcaagtcatctgagggtttaatgttttgtatactttatcttacaaaatagattccaattcatgctgtctggatatacaagcattaaggccttccaaaggcaaaatcaggctaggtgtgaaacatgagtggtatacggaggtatagcaagtagtgtcccttgatacccttggggaattggttccaggatgtcccagagataccaaaatccatggatgctctagtctctgatataaaatggcatagtatttgcatgtaatctagcccactttcctgtatactttatatcatctctatattagatataatgcataatacaatgtaactgctatgtaaatagttgttttatttgcattgtttagggaatatgacaagaaaaaagtttgtacatgttcaatacagatgcaatgttttggaatgttttggggcatatttttgaatccacagatgcaaaacccatacatataaagggctgactgtatttaagttcctcattctggtgtgattaattttatctctttttagtatacttgtggttctcaagtcactaatgttttagttataaggtgaaaggcacactgtgtaattgaatgctaaggccaattctttacctctgatgtctggaataagagccagatttcccatccttttatggaactacaagcgtcatggctattagcaatcccagaatagttctactcccactttggctgagtttaagatctttttctaaagacagtaaaaagagcatcagaaaagcatttgtgaggctgaagtacctcacataccaattttgtgggcacatttttggacccttaagttctttttgacagttttataaactcatgcccagagtagtttcctttatttaatatttgtcttaccctctacttacaggaaatgcaaggctcatcagctttttcagggagtagcatgactcagagtctgatgtacttgaaaaaaacacagcgggaatccaaacacacttatgtcatttttatgtgttagagagaaaccaggaagcatgaattctcacttttcttaacgtctttacagtgtcaaagggatatttgtgaaaagaggttgtgggaatcattgttctgaagtgcatccaagattagaagcctggtttatgtgtgctattttgcctcccagtatgagcagcctttttatatttattccaagtattactgtaaactactttttctttatacatacacaatatatctttgtctgtgatcagagcggagcttcatttccactgaccaatagaagggcatttttatttgatttaagtgaaacttggggcataatgcattctttcaaacctctgattggacatgacaaacaaaaagcttgagctagaccatggtcatctgaactatttccaataacttacctttgtaattggagtattgcctcaaatatttccctgaactctaattaccatggatacgatatcactcaacagaactttttcttaggagcactaagagtgtggaagacagaggataaatgttgtagtttcatttgattatctctatgtggatgctcacatttttttttctataaccaaccagtttcattttgatgagagtgtttggagagatggttatgctgacactagcctaggtaagagagtaagtctccctctcttaaaaaaaagtgacaatgtcacttctgctcacagtctgttgatcaaaatgaggcaaacggccaaacctgatgcctataggttgaggaaattgtgtatttgtgaatagtaatagcacagcagccactaggcctcccagtcgtactggagatttctaaaaggcaaagtgtttttagtttgttttaggtaataggttgatatttagcctattaaaaaggcagaccctggcttgacagacaaaaattaataattaatttgggagccagatacagacttaggttttttgaattcttgtttctatattcttattttggaagtttacagtttggttttatatgcaggggtgttagatgaaggtgtattgttttgcaaatagaaacagtctcaggagacaaataacaatggcatgagaaatttatgaagtttatttttagcagcactttcaggcaaggttttgccatcaatattttcattggtacccaagaagccaacagaggaggccatgttttatgaattgatgtggctacaaatattagctctgacattttttaagtgaaaaatggcagaaaagatacagaagcaaataaatatagagtctctgacagccagcagagatggaaccctttctaacaattatgaccaaaggtatgtgtgtgtgtggtagtttggtttatacttgcttgaatgctgtccttgttcttttttttttttttttttttttttggtagttcttgcaccaagtgactgatggcttcctccaaaacaatgtcagcaggacaaggatgtattggcagggtatcttttgaatcagtaaccccatactgatccttgacctaattaacagtctgctataggcatcttgcagtttactgctactgctatcgcaacatcaagaaaatgttgaaacttaagcacccataagaaacttaagggggtgtcccactcaagtcattataaattcagttttattatgctaaaattgtgtgaactatagttcacacaattcaggctggctggaagcctgaatactacattgttttatattataccacatttattggaagagttggtttgcttttaaaggaatccatcactattagtttcatggcgtatttaacatctggtcaggtcagttcaatacttggaaatgttttgatacttgaagtttccagcagattttaacacatgcctttggatgtaagtaaacacctttgtccacaataaataaaatgtaactgagcaaatgaaactgtcacaatgctttgaaaactgtagcatactgaccaaatctatgccatgattttaccttctactgatggaaagaaaagtaactttgattattgcaatctgggcaattcacttatgttatcttatttaactttcatgaaaatcttcatatagtagctatcattattccatttcaaaatgggaacagaagcttaaaaatggaataatttaaagacatacaacctagaagaggcaaagcttctgaatacaacagctatctaactccaaaggtcttggttcttataagaatccattctgttttatgtctgtgattgtaagcttttagcagtttctcttcttctatttctttttttttatattttttattatactttaagttttagggtacatgtgcacaacgtgcaggtttgttacatatgtatacatgtgccatgttggtgtgctgcacccattaactcgtcatttacattaggtatatctcctaatgctatccttcccccctcccccctccccccaccccacaacaggccctggtgtgtgatgttccccttcctgtgtccaagtgttctcactgttcaattcccacctgtgagtgagaacatgcagtgtttggttttttgtccttgcgatagtttgctgagaatgatggtttccagcttcatccatgtccctacaaaggacatgaactcatcattttttatggctgcataggcctagaaaggtgcagaaactgctttcaattcctgaagggacttgtcaggcaaaataaacatactgaaaatagctttgaccatttctaaatcctttcctggatcagagttggaggttgctcctacattcatacgcattgctgatggattctcatcaatggcccctacttctgggttggctgagatcaataaatcttagcagtttataaatggaagaaatggctttacatatcttgtttcctgaatccctttggatattttaaaagaggtgattaaagtaaatttatgtttctgcagatgcatgtaaagctaattgttttaataacagtataattggcgaaaggaagttatgtgtaataagaaacaaagcgtaccacttccaaaatattcacattagacatttgttaaatttgcagtgagtttcagcatacacacatacacaacacagaccatatgtgaacattaggaagattgatttgtttaaaaaatccacttctacaccacataagtaatatttcttactgagagtcactgaagtgaggaagaaaaataaccacataacgggaaaagaaaaacattaaatttagttatattgtatatgttttgtgtttattagtttttattaattgtaggcatgcaggtaaaaaaatcgcctcatttgaaaattaataacccagggcacaaactattaattaaggcatatagcaaatgccttttaaaagtattttatactggctgggcatggtggctccgcctgtaatcccagcactttagaaggccgaggcaggcaatcatgaggtcaagagatggagaccatcctggctaacatggtgaaaccccttctctactaaaaatacaaaaactagccgggtgtggtggcgggcacctgtagtcccagctactcgggaggctgaggcaggagaatggcatgaacccgggaggcgcagcttgcagtgagcggagatcgcaccactgcactccatcctgggtgacagagggagactccatctcaaaaaaaaaaaaaagtattttatacttaagtttttctagctgctagtttaagagagatgagaatacattcaaagagcagggaaaggagagtgtctgaacagaggaatttctaaaaatgagtacagtattaacacagttatccttacaatagcctgaggtcaggactattgttttctccacattttggatgaagggactgagacacagagaagttaagtaacttgtataagatagagaagagacagacatgaaactgttataaaaaggaaagagacaggaaaagaggagaggagagagaaagaacaaagcttggatggcaagttaacttaggtcatctacctttgaaattcaagtagtctgtaacttttgccattacatttagaggcaccctctgtgacacggtcatagaatactggttcactcttaggcattcaacaaatgcctattgagtgtcagtcatttattcaacaaacatttactgaatgtctaattaagtagcagatatagtgctagttacttgagctacattgcggagacagggcctctttgaagagcttgtgcttcctctccatgaatgctagattcatgctttccacctaaaccctacttttggaaatcaagaaaagttcacctccttcatgagacttcttggattaaccccatagtctattttcacctagaaatagaaccctgtttttgagtcatgcacgttgccagctgggataaaaggctacatttcctagtcttatacctaggtgaacccatgggtctcaggtcaatgggatgtaaataggatttgtatgagaattctgggacatcctccaagagagcagattcagctggcaggaaaggaatttgctttctgatatggtttggctgtgtccccacccaaatctctacttgaactgtagctcccgtaattgcaggagggacctggcaggaggtaattgaatcatgggggtgggtctttcctgtgctgttctcgtgatagtaaataagtctcacaagatctgatggttttgcaaaggggagttcccctacacatgctccctctttcctgtcgccatgtaagacatgcctttgctcctccttcgtcttccgccataattgtgaggcctccccagccatgtggaattgtgagtccattaatactcttttctttataaattaccaagtcttgggtatgtcttaattagcagcatgagaatggactaatacactttactacctatcctcctcctggcctggaataacatcactgggtgggtggagtttcagtcactgtcccaggacaggaggtggcctggagaatggaggccagtgcttaggtgtggagtagaagaatataaggggcttgcatccctgatgacctgaaggtcccatttcagccctcaaatagcctctttctggatttatttcatttgagagagaagcagttacatgaagtttgttactttgtttgagagataaatgcagttatattaggtttgttaattttgttttgtttttgttttagttgtatgatgctaaatccaattctaattgatatacctccttcataagataattttataaacccctggaaggaagattgttcattgggctttggcaggcagtgaccttaaaactaggaaaaactgagctttaagggcccatgaaagtccttggcttgtgggtttgctggctctttgctagaattatattttgtttttttctggttcagggtaccgtaacagaaggtgggaagctatatttttcatgaaactgattgcttttctaattaacaatcttgctaataaagcaccactgtacagcagatatagtgtttttaatgtcatggatattgtacctgaaagtaagtgaagaagtgtcagatagtttctgccaatatttgagcagtcttagttctaactgctacaattatgcaaggtatttgtcttagaagagcaatggccatttgagtaagactttccatatggtgttccacagtcactgggagaaaatgggcctttttttttccttagtgaggtgatcctctccttctttctctacaaagtaatgtggagtttggaatgaattctaatgagtgaataataggaagattttgcatactcatttggacaagataaacacaacagcatggttaaaattcttgagatgaaaggctgagtttctgtagcttgaattttagatgataaatatcaagaatctatttgaaggtcagctatcacaaatataatttttctctggcaacacttgggtagctttccttggcaaattttactcaaaaagaagataaattatttctgcctcaactttttcttttacctctcttcttctttctctttattcgattgtttgcctttgaaagtctggctttcattgcatcattagacagaattgtgtgaccattcccaaagagattgacagtgttcatggcaggctgtataggaatctttctgtgtgcaggctggtctacaatttagcataataaagatctggccttatattcataggatctagccaggaaaattagtcttacctcagggtttaaagaaatgagggtgtgtcccagagggatctgtctgtggccagcaggaaatttaattttaaaaactgaagaatatacaatagttcaggcactgaataatttgagcctgcgaaggtgcttctgccacatatattatcatagtgttagtaaggccaggaaggtctgaagtttgtatgagttcacagatattttgaaagactcatgcaggtatttttgatatgattccattttaaaatcacattgtctgtgatgtgtatttatggcattatctaccacatgtgtttgtcctgtagaatttacattacaaaaccttctctgatcaataattgacgatgagtgactgtagtagtttgggaaataacttgctttttactcttttgtcacctgcttcaatatagttcctgctgtttgatgagaattgactgagctggagcctgcaaaagtaactgtagtcaaattagttacattaaagggtcaaaattatagctgcgtggagctaaggtcatggcagaaccaaagagctctgggcacagatcttcctttcatgctcgactgggtccaataatcccccgaggctcaggtctctgattgcatttccagatggtctcctctggtgtaaacaccacccgcgctctgtccaacagcataagctaccctggcagaaagcaaaacagcaggtcagggagccctgggaattacacagtgggtggcacctgttgccaaattttgacctctctcatcccctacgttatatacccatgatattttcaacttacccctttcctttggtatttgcagggcaaactctctagtttcttagaataaagccagcttcatccactccccttcctaatctccatatattcttcaaactggtgcttagatttcctggctatcttgcagatgaattctaatatctactagtcagtagaatgcatttgtgtacttacacacttattattcaacaaatgcctattgagtgtcagtcatttattcaacaaacatttgctgaatgtctaattaagtagcagatacagtgctagttacttgagctacaatgcggagacagggcctctttgaagagcttgtgtttcctctccatgaatgctagtctcatgctttccacgtaaaccctgcttttgggaatcaagaaaagttcacctccttcatgagacttcttggattaacctctctcagatctgagcaggttgtccttctagaattgtcttaatgcatacatttgcagtcccttgtaaccttgttagactgcttctttcatgtagatgttttaaatttttcatagtgtgttgtgtacttgttcaaacgcaaactccccaagagagattcacttctggcaccttcatttttgcttttcatttcccctaatacattgctggacacttaattggtgttcaataaacatggtgaattcatttaacaaaagttattttgcacctaccatgctcacggctacaaatggacagcattatcacagcaactggacattacatagcatgcggaatggcagatggacagaccatatctataatatacttgggtaaaattttgaatgtttattagaatttcatccactgtctcatgtcttatagctacaagttaatttccaaatttgaatatgtccatacttgtttattaaaaagctggggacgatactctgtgagggtttctaaggagcatttgataaggtgtaaaaccactatagtcttggattcttctcattgctgagcagaatgggatgtgtcctgcagcaggttgagtggctctatgtggttttatgaccatacgtaggaacctgcttcttctcttgaaatggctgttttgttttatggagattggctagactggcaggtgacaaggcaagaggtgggctggccacgagagccagctgagcagtgcgagttggtgtgattcagccatttgtcaccaccatattctgccatagatagatattttctattcgagaaagtggatcaaatttcactgtacaccactttctcactaggctagaaatacatgaatggtggggcatagttcactccaaatctgatccatctaaacttttctttctggtgagttgatctgttttgagattttacactttacataaaaatagtatagcagccactctttgccagtcacaaaccacctttagctgagagtattatcatatcaattgtttcaaggaaatgacaaatgagtagttaccaaaaaaagaatgaatgaatgaataaataaataaacacaagggaatgagttgttactagacagagaagaaaaagattgcttggcatgtcccaatttggttattgaaaatttttatttttgatgcagtgctcttcttttttccttccttccttccttccttccttccttccttccttccttccttccttccttccttccctccttccctccttccctccttccctccttctttccttctgtaacttaacacctatttgattttttgaaaacattttttattagatgcttagatcagctgggacaacttaaattgcaagctaccagaaatatcatattaaactaaccagtgaagatgacagtttggatcatggaggtagggttgatttcagctgaggtttgctttagcagttgcaacactgtgatcaagatctgccttctctccctccatttcaatctagtttcctggccttggctctattctcagcaggtcttgtcttcctgttcctaaattggccatgagcatctcattccttattctaatccaacagggattatacctgttggtatacctactcctcctacttcctcccttagtctgtgggggaaaaaaaaaagaaagaaaagaaaagaacttctgagcttcaatgtgattaggtcatatgcctatcactgaactgatccctgtggatagtgatgggattttgctgataagtctcagtctcagcccctcccccaataccaccatccactttacagctgtggcttcactcaacttcccttgaaacactgtatggagaggaatggatgcctaaatgacaacttgggtgtcattaccaagaaaaagggaactatatgcaagacagtcaaaaactaattaaatgtcctctctaaggtttcatttttaagatagcacagagtttgctgctgctcctcctctttcttcttttttttttttgagacagagtctcactctatcacccaggctggagtgcagtggcatgatcttggcttactgcaacatccgcctcctgagttcaagtgattctcctgcctcaccctcctgagcagctggtattacaggcacacaccaccatgcccggctaattttttttgtttttagtaaagagggggtttcaccatgttggccaggctggtcttcaacttttggcctcaagtgatctgcccccgttggcctcccaaagtgctgggattacaaatatgagccaccgtgcccagcccacattcttcttaaagggtttgagattttttttggaaattacagggcatatagctttgtgctttattcaaaatgtcatagagcttcaaacagttcttcctgagacagatgtaaaacaattttaagatttctgagaagtaatttatatatccttataatagtcataccatgtgaaacctggcctgctaataataagaagaaacatctggaactagtgacagggtcaattttgggtattctctctctatggagaggactagttcttctgagattgatgttggcagtttggaatcttttcccagtgggaaggaagacttagaagaggatagttgatattgcctctcctcccacaagcaagtttcatctttatcacagttccctatggctatgccattttgagatttgtatacaaaccctgtacattagtgagggactcactcagagaccacctagactccaatcagtatccagcctttaggagatggcttgacctgggcagcttccccagtgatggagtttacaaaggatgacaatgaccatattttaaatctgttgttactctcttgcaagactcctctttttctcttgcttgctcttcaccttagcacgtctgtacacacctgcctttggtataacttgaaagacagccctaattgaggcattcatctcatacaatccaagagtcaggaacacagcttttggaaggaatgcattgtggattcttcagatgtgatttaatgaatatccaactgtacttagggactaaaaagagcatttttaaatgagattttgctctgaattggaaagtaagttgaggtgggaaataagccagccattaaatgctctagttttttttttttttttttcttgagatggggtctcagtctcactctgttgcccaggctggagtgcagcagcatgatcatggctcactgcaacctccaactccccatgctcaggtgatcctcccacgtcagcctcccgagtagctggaactacaggcatgtgccactatgcccagtaaatttttcataatttgtagagacagagtttcgccatgttgtccaggctggtctcaaactcctggactcaagcagtctgcccaccaaagcctcccaaagtgctgggattacaggcatgagccatcgtgcccaaccatagattttttttttcataatggcagagaatggctgcaatttagggtctttcttaggttcttcctcatccatttcttgcagaaaatttagtactttgtatttctttcaataatttcaacaattttatcctgacttttcccagagcaaaaattaggatggggatgttagagcttcctttgagcaggctatcatcgcaatgaaatcttgaccttgccccttgtagttgcctattgctttataaaacttgttattgaaattgcaaacagtccaaattatatagtagtttctaatgtactttatcagggtgtcagtttttcttttgcaagtgttttgaggagatcagattgttaatgaacattctttgagaatctgaacctgagaactgtctctttaggatgaagttaccaaggacagatgcaaaatttgcaaagatacggtgttccagcctcctccaacaaaggttaacaaccacccgagaaccccagtgccacttacctaccacctcttacctttggaagcagattgcccagtgacggataagtgtggaaactgttcaaagattgggaaagaaaattgttagaaaaggcacatagagaagagtgggattgggggcaaaaggagaaggaggatagtcttctgtgtttttttgattggttaacttaaaatctcagctatttgtttacacaaaggctatgttgatgtccatattcaacagatacaggtatttggctcagaaaagcacatggttcccagaccatttgccaaatgtcctatccttgttcagctttggttattatgaatatccttctggaagcaactgacacctaacatgtctgaatcctctggacctgtagagttcttaccccggagtgattacaatttctgaaaagaacatccctgcaaaattagctttcaaaatacgtgcagataagcccatagaactgggaattcctccagggaattatatcctaagtagcctactacaatgcttgattccttgggcaccagtggttgctcaataggttttttaataataaaaactagaaggaaagaactattgttagctaaagttaccatgtaataattggcttgggtatgtccctgcttgtttgaattgcttaatgtctgttctttgcacagcagaaactcttgtgccacttcctgattagtcatcttggtcttctgtttcctgagctgtgctccatgatctcgtgtaaatatatacaatttgtgataaaatcatcttgctcattccatagcaggtataagtgggttaattctattgggaaacaagctcaaattttaacagaagtttttctttgcttcaagggaacgagtttcccaacagtgggaattttaagcattttggcaaatcaataggggagatattttcaaaccagcatgattctatttggctcaggtaaaagtaagcccttctggactggcttgcaggtgggttcttgagtcttggcttatttaaaaagctgctgcctgttcttaataaatgccatgatatgaggcaccatgaacaagctggatttaaacctgccctatcaataattttactcataagttcttggcaagtatgtttgttgtctgctgtctgcctgtcaaggttgtcagttagctaagcatcagccaaccacatgatgctgagtccccatgattaatctgacttggtaatactgttcatctatgtaaagaattggaaaaagtagatctcccttcatgcgtgtgcgcgcacgcgcgcacacacacacacacacacacacgcacaccaatttgtttaaaataaaaaaagattagacgaaagcataaaatcagccctctggtctgaagcaattaatctgtagaagatgctacatatgctgggtgtagtggctaatgcctgtaatctcagcagtttgggaagctgaggtggcaggatcacttgagctcaggagttcaagaccagcctgggcatcaacacaagaccttgtctctactaaaataattttctaagaatagctggatatggtggtgtatgcctgcagtccctgctgctctggaggctgaggtgagaggattgcttgagcccaggagactgaagcttcagtaggctatgatcacatcactacactccagtctgtgtaacaaaatgagatcctgtctcaaaaaatttaaaaaataaaatgaaaaagaagatgctacgtacattatacacatataaattagtaaccaaatggtttaacaacctcagtgattgtgttgttctgtagtttgatgacttttatcttgctccttctcattgccattgattgtaccaggttatttcctggagcatgttgtatatcaaggtttatgcaactgtacatttaacctttcagtgcctagctttccccttttcctatagaatcacaagaatttgaaggcaacacaatatgttttctatcttatagtctgaagttaatgcatattaatggcatgctgctattactagttaatactgatgccatgaggattagataatcattgtaaaaaatgtttaatagagcattttttacaatacttagtggatgccagtatactaaatcctttatatatgcttaggtcttttatttcccacaaatctgtgaactaggaattatgaacgcattttacaaaacaggactcgttgcataacttgccaagtcacacagctaatgaacaggagagtcagaacttgaactcagggttgcctgcctctaaagtcctccactaattctcattcattctgtaaaaatagaacatggcctctagaatctcgtcatttagaaaagaacagccttttggagattggttagctggtttgagaacatgtagtttgtttatctgtgtctttgactagtaataacgttcagcctcattaaatctagtaagctaaaaggaagcaggaaatggctgtagtatagacgcttgatatttcagcgatgataatgatggataataatgtgatttcacagcttgggttatcagacccaggtgagtggataagtggattcagattcattaaaatcaccgggcctagtttgtggccttcctttcacaaaccccttaggctgcatattaccctttaatagcatatttttcccattatagttgcccttgctattcatttcaaccacattacaagtataaacatgtacaagggagaggacagatgtccttcccttctgtattaactctcttgttgtatgaaataatgttatgtattaaattattgtctcagtttatagagtctgctagactgtgctgttcagtagaactttttgggatgatggaaatgttcaatgtctgtactgttcactaaggtagcaactagttacctgtgttagttgagcgagcacttgagatatggatgatgaaactaaagaacagatgtttaagtttatttaacccatctaaatttaaatgtaaatacccacatggctggtggctaccttattggacagcagagatttagaatagtaaagctgaatggaccttagagtacatgtaaggcaacacattctttttattttagaggaatgtaggactcagagcatgaaaaggagtaaaaccaagcctaggatcctggtctcttgacttctagttcataatttcttccactaaacttaaaattgttaaaaatgttactttgaactttagtatttgaagattatcgtggtaagactttgcttatatttacaaaagcattgtaacagaaaataaattttgaattacaactgtgactttatcatatttattttacattttatgattgctaaataggtcatatattgacgtctttacatatttgttgggagcaaaagagttgaaagtaaagttttcttcccatctatgttatttagccattgattcccctctccaaagggatcagtaatagtttctttgtgtatctttttaaacattcagatatattaagtatttaaaactgtgtattgttctctcatctttttaaacaactggtaggatatgtacactacacattcatatttttgcattaaacttatatgtggagatcttttgatgtgagtacacaaaaagggtactttaaaacagatacataagcttctattgcacgtaccaactgtagtttaatgcatccctatcgatgaatatttacttcctttccaaagttttctcttaaaagtaatgctgtagagaataactttggacacataactttcatgtgtgcaaatacattataagataattcctagaaatgaatgcactaggtcaaatagtatatacacattttaaattttgataaatattataaattgctctccatagagtcacagcattttatattctcactgacaatctgtaatctctatgccttcatcaacctagtgtgttaccaaactgatcaattcataccattctgacaggtggaataaaatctcagtgtagtttaaatgtacatttttaaaaattgtgaatgagctgggcatcttacatatatgtaagggccatttgtattttatttattgtgaaatatgtttgtatgctttgtccatttccatcagtttttaaaattgacttagaggagcttttatatataagacaaaatatgacatatatggtaaacaaaatgcaaacattttcttcagttgtttgcctttttcactttgtttttcatggtgtttgctatggagaaaatataaatttttacataaacagatatgccaatctttccttttatagcttctggttttttgagtcaaaaattgagagaccttcctcattctgagagtataaaatagtaattatttttaattttaattaatttatttttattgacacctaataattttgcatgtttatggtttaccatgtgatgtcctaatacatgtacatattgtgaaataatcaaatcatggtaattagcatatcaatcaccttaaacatttatcattcctttgttgtgagaacatccaaaattctctcttctggctgcttgttggcagtagtcaccttactgttcaacagagtactagaacttattcctttctatgtaactatatctgctgaccaacctcttcccatctcccactccctcctattctccctagtctctggtaactactgtcctactttcaacttctatgagatcagtttttctagattctacatgagtgagatcatgttgtatttttctttccatgactggtttatttcatttatcataatgtcctctagcctcattcacattgttgcaaatggcaggattttatcctttttgtggctgaatagtattccattgtgtatatgtactgtgttttctttatccattcatcccctgatggacacttaggtggattctgtatttcactattgaaaatactgctgcaataacatgagcatgcagatgtctcttctatatactgatttcctttcctttggatatatacccagtaatgggattgctggttcatatatttttaacattttgaggagcttccatactgttttccacaatggtagtactgatttacattcccacgagcagtgtataggagttccctttcctttacatcctcgccagcataataacgattttaatatatttggaatttattctaaagatgtaaagtatgactcagacatcatttattaagcaatccatctttttcccagttatttgagatcccacctttatcacataaaaattttaatatatctttgagtcaacatctcactttgtagtctcttccatggaatctgcctattcttgcctgtaccacctgttttaattattttagattttatagtgtactttaatatattgaagaactattctctcattgctgcatttcttttttaggctgttcttcaccactgttacttgtttatattttgtatgaaatttagattcagcttgtctatttcaaaaacaatttctgttggtatttttagtaggatcatattaaagttcaagattgatttagagactttcgaaaagcattgaatctttctatctgggaacatgatatgcctttccatttgtttaagcattcttttatgttttctgtcagtgtttaatggttttcctccaataacttttaccatctataatttagcttattcctacattgttcttttttatgtcttcaaaatgggccttttgcatgtatgcatcaaagctattgacttgtattgattaacttgggcctcttctaaattttttcactttagaaaaaaaatattttagcaattggttattttatgttttccaaagacctaaatataaatgtacaggtgatgaactgcactttttcctttgaaatttgtatgcctttactttctttctctgatataattgtattcactatttcctccagaactagttaaactagagtagaaatttttggcatttttttggttcctaatcaaagttggaaaaacagacttttcccttgaaatgtagtgctggcatttaggttgagatagaaatatttcattatatgtttttaatcaagaatggatttgaatttcatcaaatactgtttaaacatctatgataataatttgaggtctccataggtttattaatatcataaatgaactattttagccttataactttaaaagccttattcttttaaagttttattcattctcctcccattcttgttcactattcgttgcccattcttgttctatataaaaaccccagtggtccctgctgtgaattcaatgacatcttatttcttttccttaagtcagagcaaatgtgcacatcagaagagcaaagtgtcaagtaatgatagctggaaattgagccacaaataaacagaaaatattttcttcattgttatttgtgtgtatgcttgtgcttctttttttcaagggagtagaccactgttccacatgttccacagttgttttatggtggaatgctctagttatggaaaaggagaatggagtctagccgtataaagttactaaacctgcttggatatgagtcaagggtatcctttttgtgcccaaactagaaaacctttccccttctcatatttttgagcaaggtgttttatgttgcaaagtagcccactgtctcttttcaactgcataagcccaaataacattttatattccagtcagtcacaaaatgaaaacaggaaacgtctttgaagcaaggcaaaaatgtcagagtgtctaaaacatagaagtacttggtgaaacactttcagcgtcttagctctgcctctggctagtcatttccactcgctgggctcagtcaggtctttcattagtgaaacagaggtggctgagcacttcctgtgaaatcgcagggacaggattgtggccctctggagagggggccaggaggaaaaggaaccagacagctggttttcgggagccaccagatgggagcaaatttccaaggctgctgagaagaatggtctagaataacagaattgttttgtgaaggagccttcctaaaccaaatgttctgagcgtccccgcaagcagagcaaatgagcacatactgtgttcatggggaaaaggacaaatgactgtacaaatggagtaacaaacaatttacgaaaatgtatgtggcctaaatttagtatcaaggtgatgggcaaaatgacttacaccaatttgtgacggtcctgttgcaaattcaatgacaaagccagccagtctacctagtccatagtatccagcagatatatcagtggagatggcccgagtgcaggctgcttaaataagataaatcatctgtgaagaaggaaaaggtcaaatgtgctattctctgtctttttttttttttttttggtctgaattaaatggaaaccattacaatttcttccaagaaaataaaaatcagcacctacaataatgctgtctccttctgaccctgccaagtctgactgcattccacctggaccctgcctttgtctctcatgtttttatccaagaataagtaggctaccttgtagtaaacaggaaatcttactcttacctcgcactagttagttatgcgtggtacttgatccataatcttctgcccccatgtcatagaagataggtttttccaactctcagatggaaaatcactagtgcactacacacacacgcactcatgctcagaaatattttcacagatccatttttctctgtgtgacggaggttacataattatatcagtggatgtcctgcagtccagctggtatatgtagagcaactgcatgtttgtatcactctgttaggtgcagtgtaggacacaaataaagagagagaagggagagaacactgccgagtcattaggggcatgctttcagttcctatacagccaagtttttttttaggcttggcctatgcttttttcttagtttgggtttagtatgtattcattcattcatattgccatgtgtgttcaacaaatattttgggatgcctgctctgtgccagacattgtgctaggttagagggatgcaaagacaaattagaactccttttctcaaggagacttctggttattgtatttgtgataaagttttaaagttactatactttgcctgcctagaatgtagttggatctcaaaagaattactgagggttggaggtttgagtggcagaagagcaatgattgatgaaacagagttttgaaagatgagtggcctatttgtcatggaggtaggaatggggggtgggtgggcttctggagagacacagcagaagtgtagagaagaccatggtacttgtagggaacttctgtggtttagagtgagatggatcttgcaagagctcaggctggagactgagaaaatgctaagtcatggggggtcttacacaacattctagagaatttagactttcccctgtagacactgaggggccgtgaacagcatttgtacctctgcaagatttttctggcagagacatggaaaatggtttagaaggtgaagataaggagctcaattagtgggctatttaaagtgtgcaatccacagataaaaggcaaaaacaaaacctgaatcagaagagtataccagaaaagggtgccagcctattatatatggcaatttatgatttatttaacattgaaggaaaaaacaggccttcaaaaataataaaataagaaggtgctagctatttacccctataacttcaggtacaagaagaatatttttattttactgagctcctcaactgatttaaaaaattaatactcataccagattgtaaataattcaaggaatcatagccccttccttactttttttacatttgtaagatttaaagagtcatacacccagataacatcaggctgcagagttttagagaccaactccttcagtgatttttcaagatgagaatgttctccatgttctcctgcagaagcttctctgggagccccaatatgtacaagagacagaggtagaccactggctgtgccttccctcctcctcctccccattctactcagctctgaattgcagttgcatagtttgcaaacttaatgttgtcaaaccttgttattccataatgggggcatagttgtgcaaactggaagtgattgatttacccagggacagaagacttggttaatagtagaaaaggatccctaggttccctaattgttggacaattgctcttagcagttttggttaacctggtttttatctggcttctcagtagagatgattctttcataagatcacctgcacacaaccagctactcatatatttgcttatatgtgtcatatctgatttatgtacattttctgtagacaagcttgttttaggtcatgtacttattacttactaagtgtttgttttctccatacttggggatctaaattagtaagcaacaaactgacttggtgggttcaactcaataatatccaatgaagccatttcttcccattcctaaatcctaatttagctgtgggaagtttggatcaatggaaattaaactccatatatgccaacactatgggttgataacctcttccaagaatcattgcctgaccatcatgttccttctacctgaccactccttcctgcacttttatcacatattactctaagggatcatgtctaactttttgtcttcctcaattagactatttcttgaggccaggaaatgcatcattttatccatagcatctaactcaatatctaatgtgtaataaactcttaatagaaatttacttaataactagatagatagtttaagatatgcccttgatgtagtcaagaagacaaaatgtatgggtacatttccttcttgtgtctggttcctctttctgcattgtcagggcaagttttaccctctaatttcttgtggaccagcagctgtcttaattgacagtcccaccaaaccctggatttcataggatgtcccagacaatgagaaatggcttgaagatagaaaattgtctgtgtcttaaaataatcttctataaattatgcgtattaacacagatatgtagcaaactataaaggttattttgctctgaagaggaattcagaattagaacttggatgtagcaggacacctctgttctcattgccataaagaaaaaaaaaacaccttttatattgaatttcagtgaaccttgcagccagcatctgtcccattaattttcatatacgagaacaatgtggcatgattactcaccagcaacagaagtagcagttttataaatcttatgttgtagtggctggaagggacagggttgtgctctcattgtttccatattctttgtgaaattcacctttgcagggggtggtttgctctttctcttccagatgtgcacagaaatatgccatgtcactaaacgtcatgtggcttaacatttctccaattttcagctaatctactgagaaagtagtaattttttctgactagtggtggcctacttctcctataaggctgtcttttacaatgagggaagttggcctcactttatttataaaggtgcacctaaggctggtgctttctggttctggggctgcttaatccaccctctgtttcatttgatcctatagagtttgggggagggctgaacaacagtttcattgacgtgattcagattcaatttgctaagaacctgattgtgtttatgacattaataagaaacactttaagccttttaatacgaatccccagtcactctgcttcttccctttctactgatgatactttgtgatctacatagtttaaactttcattacacaaggaaacttctactaccacttgatgtgtgtgtgaataggctatggggaaaaaaaggttcatttttgtttgagttttttacttttcataggtcattgtcaatgtggtaagtatgctctttagtgggatgatccaacactagggcttcatattcaatatcatttacagaaatagtaaatgtcaataacagctaatgttcattgagtgctaatcttccaggtactgttcaaagagttttacctattatcaactcaattctcccaacagccatatgatgttgttactgttattatagataaagccacttaggcacaaagagattaagcaactagttcattgttacagagttggaaatggaaagccaggtcctaacccaaatgctctgttgcgcacttctctgctgtctgcaggtgggatgagaggtgggtgctgagctgcctcctgtggtgctgttttgaaacctgcccatcccaaagctaagggagtatcgctgtgctaaagggttcagtcagcagccttgccagttcggaatcccctagaaccaccctccatgcatgtcatgggcagctctctgagatttctggtgcctcttactggcttgttaagttggcagatttttctccccatttgcttccttcattataaaattcccatttccattttgcctctaggtagaagctcatggaactcaaatgggaaatgatgatggtggattttcctgctgaaaagatgtacctcaaaaggaaaaaatagtgtatttaacatggagaaatgaaatcctccgaagggagcttcatgaactaaattacccagaatggccttactgtctgttgtcagcatttttctgctgcccctttgagcatcagtttactcactcatgtgtgggtcagctctactcatctgtgaaggtagataataaaacctacccccaaaaggttgcagtgaagattaagtgatgtcatatttttaaaaatgcctctgtaggctctggtacattccaatggcttggtgaatttttttttttccttttccttttccaaagggaattaaaaaaaaatgagagtgagttttgaggatcctagagcaagtaatcccagcactttgggaggatcatgaggtcagaagttcaagaccagcctggccaacatggtgaaaccacatctctactaacaatacaaaaattagctggatgtggtggcgggtgcctgtagtcccagctacttgggaggctgaggcaggagaatcattcaaacccgggaggcggaggttgcagtgagctgagatcacgccattgcactccagcctgggcgacagggtgagactccgtctcaaataaataaataaataaataaataaataaataaataaaacagcaaagcttctatgaattctccttttagcccttcatataagtctattcttcaggagccagtttatattttatggttagatacacatattaaattattggtatgtcagatatgattctattagtagtctccagggttcatagcttgttagggaaaatcctcctaaaaagaagttctttttgtctattcttcattaacttatttcacttgtaaagcattaaaatgggtcctctttacatattatgttgttttctaagggacaaatactagtggttattattacagttctttttttcatgtttggtacttcagtggttgattaactgtttcttaatcctgaaatgtggaggaggtttttgcaagtggttgtagcctggttttgaatgaaggtgaaaatgctctttttgttagctctagatcagcagaggtgaataagcatcatgaatttaggagactggcgtttttttttacataaaagttgctttgttgctaattagtagattagaattcctttaattgcattctgaccaaagacttttgggtgttcaggagggcaagttagcatgtgttgcatttgaatttatacatttgagacacattttcttactgaagctgatattcatgaagcagaaaagataaaaacttgtacatacctttttatttcttgattttaatgttgaagttctattctcagaatggattttataggcaacaatatgcacttaaatttatgatctgtttacgagacctcactgtattttgacagaggtcaaaataagggaaatcaatcttggttctcattccaaagagttttttttcctgatatcttaaaaaggctttattacattatgttgatatccatggcagagagttccaaagacatccccatgaaagggctataaatgtgaggtttgaaaccaaggcaagtcaagcagggtaagcaatcttttcacccaaggttttaaaataactgctgataagaccttctcacagattttcattcatttcttcctagttataggcaggaaattctgaaagcaggtgaattctaaaattaccttataacttgatttcagaatatagttacacaaagtgagaataactcgatgaggatgctgtttggatcttgagtactgtaagtcctgtggtttaattgacgagttgatggatttcttttatgcctaaattcaggctgaaaggcctaaaggccacacgaggcagtttatcacgagcgctattctccgtttttatattctggttcattaccagccccttcctcagtacttctatttatataatgttgttctggtcaaggtttatactaaatctcttttaacttcaacatccaacaaatatttttaaggactaatgtgtgcaaaacattatgctaggtgtttcctaaggcttcaaataacttggatgccagttttggactgtaagtgctcacaggataatagaaaaatcttgtttgcaaataactggaacataatgtacaatggaatgtgtcataaggggagtgcacacaatgctgtaggaattccaatgaaattcaccctcatctttcattgtattccctgttatttacctctccttaaaagaaagaactataagaactctacatcttttagtggcgatttcctagatagaaaaataatgaatattaaacatgatgtgttaggattggtgaggctgaagaaattctatgcattttgtcatttagtgaatatgtattgactgcctgcctattcagtgtcaagcactataggtggtaatgtatcaagaggttcatgaactaataataaaggggcacctctgtatttcacaaatatttgctgaatgaatgaactcattatattttattctcctatgtgattcctagataagttctgctacctaaaggaaagcacttatggaatccaaggtttggaaagggcttgaaagatcacattaataggtttcccttttatttgcctttttgaatctcaatatggaataactttgacttatccatactaaattgcatctcattggtgttacacaatctttccagtttttcaagattatttttaacttatgccaacaacatattaaatatcctttccatctatgggacccattccattttctaagtttacctaagactttaaaagacattaagccatcagagccaaaaacagagtttctctacttccatgttgatattctccttaatctacacttccattcattcaataaatatttactttcagggtgttcggatgagctatgggttacatagtgatgaattcagcagacatagcttctgccctcatgaagcttacagcctacaactacagaggatggggctgttgaagcagctaaaaaaccctaccttttctactattgagcaataaaagaaatgtttttcttgaatttctgagatcatttcttgccagtctttgctcatgtcactacctggaataaactcccttttatcatattgggttatcaacatcttatacattcacaaaagaccacataaatgttaccagctgcaaaaatcttattcatgtctgtgaaatccattaacatgtggcaccacttgagttgggctcatcacttgctgatttctgctgtcattatttgtgaatgtctaatttcactgtaagctcatactgtcctttcaaacatgaatgaggcctttaacattgttgtatcaatccataacattgaacataataccctgtttgaggaggcatgactatagaccctttctgtccaataataaagatgttggtaagagtaaataaaaggtctcatttcttgataaactggttagaatcaaggaggtctgagcatgacactagggttcctaaatactttcattctagacacataaaacctctagaagattaaattcagacaattttaaactttagatacacattacaacacaaagaaatgcactattataaattttaatgggggaaggccggtaattcaggaaactgtcagatctgaataatgaaataccagatagttcttatctatttacatactctgtgatttctaacactctgaacaataatatttcagggttctaaatattggttagatttttaaagttttcgaaattatataactagatgactgctctcaaaattaggccggtattttggattacacagagtgcctaaaagtgcatttttcctcctgaaggggaaagccatgtgcctagccaatattttcattccctaaggatccatggaattatgatagcttaccctcatcagtcacccaggctcccattggtgtgaattgggcaatgctgtttacatagcaaatacacttccttttatacaagggtccacaacccctgggccatggaccagtatcagttcacggtctgttaggaactgggtcacgcagcaggaggcgagctgcaggtgagtgagcaaagcttcttctgtacctacagccactctccattacttgcatcaccatctgagccctgcttcctgtcagatcagcagcagcagcaaattctcatagaagcatgaaccctattatgaactgcacatgcaagggatctaggttgcacattccttatgagaatctaattgctgatgatctgtcactgtctcccatcacccccagatgggaccaactagttgcaggaaaacaagctcagggctcccactgattctacattacggtgagttgtacaatcacttcattatatatcacaatgtaataataatataattgaagtgcataatatacataatgcacttaaatcatctccaaaccatcccccactgccaccctggagcatggaaaaattatcttccacgaaacagatccctatgccaaaaagttggggattgcagctttaatagactcagaggcatagtcttagagtgtaacaaatgcacaaaccttttcttttaaaacagactccagagggattgaagagagggaaccagtgataatctatatgcccatttcatggcagacatgctgctgtgtgctttccatgcattatatcattcatccaacaggcatctaaagaatatagagtcaagaacagttaagccattgccacaagatcacctagctagtaaatggctcaaactcagtgactcaaacccaggatttccaaccttaaataaggctctcactcccacaccgcacagctgcatatctgagtgtttatcagtgaattacattgatgtaaattcatttatgaaaatgtcaagatatcgtgagcactagtgcttttaggagagaatatttaactcatttcagacaacatatattaacttcatcaaaagtttgcctgttataaacctgtgactcactcttggtcaccatgatggtgcaacagctgtccactggacaaatactaaataatattttatccttgccccctatttcttatgagaaagccacaatgaacttccttttgtctctcatttcacccttaaagggacaaatagcattgcattatccttgaaagggtcttctgctgacccatctttgacgcttccatcacagggtgacgatgggatgtttgctgtatcacacttccctgtgctttcatgaatgtgttactggtgatgaagaatgccaattctttgtttagtagcagtttgctgggtctccctgaaaataatgtgtcagttaggctacctataaatctgagtcagtaatgtacttctctaaggtatatttatgttttgaatttgtctctgagcaatctgttggggggaaattttgctttaatatgttttataaaaaggtgagaaagtaataaagtgtaatgaagataagataaattttctaataaaataaaatatagaagtgttcaaaatttttgctttccccatatgactttgttttttccccaaatgttaccctcataacaggtgggttctgtctcttgatgggtatcaacacagtgaccacaaccgaggaggatttagcaagggaatcttactacttgtaacaaataagggaaacaccaggagcaattcccaaagcagtatctctccaagctggggggcagtcagattttataagtgtagggtaataaggtgtgatctgattggattctgcaatgaggtgttgtcagaaggcataatctgactggattttgccatgggatgatggcagagctcaatctgtttggatcctggatcctgccattgttgtgtctgcttttaattcagtccctactccttggtcagagcacttaggttccccctgtggttgcactcttggttcttccgcacatggtcaggttatgtgacctgagggtccatggcaactgaaaaacaagaggaactttgttacataaaaaattgaaccagatttgcctggcatggctacacaaatggatgtctctgttcagccttatttatccacagtttttcctcctgctgatccctttttcttgcctgtcctccctgcctgctcacttgctttctggcctctcttgcctctcttcttagccagagctgtatagggatttagttcagtgtttcctccttcattgtcattggacaatattcactcatcagctccaggtcacctccctgtcctcacctgtgaccagtcttccttccaggttcattgccattttcaaagtgagtctgcactctctcaccacccgtttgcttatcacccactctctatgtgattacttgtgatttgacatctgcccatgctactacaatgaaatggctttctcagagactatcatatgtctctattgacaaaaccggattagtgctgcttattttctgcagtatttactgttgttggacaccgcttccttcaactttctcctctcttggttccagggcactatactaactttggtggccatatactcagtgcctccttatacatgagtggaagtaaggggttcagaatgaaatgattcagtcagtctcataaagagataggacatctgtggagattaaagttctcagagttagtagtctcattgctttattccacatgatgttgacaaagaagtagaaagggaaagccaaatccttcaatctatattgctaattaaaaaatgattttcttttcttctttttagtaaatgtttgatggtgtcttgggagtagccttagtagcaaaaggaaatatttatgcatgtctttgggaaaatgtctttccattttctgtggttattgtatctgtaaaaattggacaccatttcttaaaaggattatgtgaaaattttatgatgcctggttggtgaaaggcagagtgtcctgaaatatctaaaatgtagaatcatattctttctattgttttgatataattagaagtgtcgattttaaaattacactgaaaggcattttatttttaacattgttttattaggtgagtgcaaaagtaattgcagtttttgcattgttgaaatttgccatttgatatgggaatacattcttatttttaattaattaatttattattattatactttaagttttagggtacatgtgcacaatgttcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcagtgtctggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacaccaacttccacaatggttgaactagtttacagtcccaccaacagtgtaaaattgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcacgtcctacgcccacttcttgatggggttgtttgtttttttcttgtaaatttgtttgagttcattgtagattctggatattagccctatgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttcatggctttaggtctaacatttaagtctttaatccatcttggattgatttttgtataaggtgtaaggaagggatccagtttcagctttctacatatggctagccagttttcccagcaccatttattaaatagagaatcctttccccattgcttgtttttcctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagtttttttcaattctgtgaagaaagtcattgatagcttgatggggatgtcattgaatctgtacattaccttaggcagtaaggtcattttcacgatattgattcttcctacccatgagcatggaatgttcttccatttgtttgtatcctcttttatttccttgagcagtggtttgtagttctccttgaataggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaatagtagtggtgagagagggcatccctgtcttgtgccagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttttatgctggattacatttattgatttgcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcggctgtgaatccatctggtcctggactctttttggttggtaagctattgattactgccacaatttcagatcctgttattggtctactcagagattcaacttcttcctggtttagtcttgggagagtgtatgtgtccagaaatttatccatttcttctagatttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttcttctctgatcttagttatttcttgccttctgctagcttttgaatgtgtttgctcttgcttttctagttcctttaattgtgatgttagggtgttaattttggatctttcctcctttctcttgtgggcatttagtgctataaatttccctctacacactgctttgaatgcatcccagagattctggtatgttgtgtctttgttctcgttggtttcaaagaacatctttatttctgccttcgtttcgttatgtacccagtagtcattcaggagcaggttgttcagtttccatgtagctgagcggttttgagtgagattcttaatcctgagttctagtttgattgcactgtgatctgagagatagtttgttataatttctgttcttttacatttgctgaggagagctttacctccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttaacagtggggtgttaaagtctcccattaacaatgtgtgggagtctaagtctctttgtaggtcactcaggacttgcattatgaatctgggggctcctgtattgggtgcatatatgtttaggatagttagctcttcttgttgaattgatccctttaccattatgtaatggccttctttgtctcttttgatctttgttggtttaaagtctgttttatcagagactaggattgcaacccctgcctttttttgtttcccatttgcttggtagatcttcctccatccttttattttgagcctatgtgtgtctctgcacgtgagatgggtttcctgaatacagcacactgatgggtcttgactttttatccagtttgccagtctgtgtcttttaattggagcatttagtccatttacatttaaagttaatattgttatgtgtgaatttgatcctgtccttatgatgttagctggttattttgctccttagttgatgcagtttcttcctagtatcgatggtctttacattttggcatgattttgcagcggctggtaccggttgttccttttcatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggagttgctcttctggaggagtatctttgtggcgttctctgtatttcctgaatctgaatgttggcctgccttgctagattggggaagttctcctggataatatcctgcagagtattttccaacttggttccattctccccgtcactttcaggtacaccaatcagacatagatttggtcttttcacatagtcccatatttcttggaggctttgctcatttctttttattcttttttctctaaacttcccttcttgcttcatttcattcatttcatcttccatcgctgataccctttcttccagttgattgcattggctcttgaggcttctgcattcttcacgtagttctcgagccttggtttttagctccatcagctcctttaagcacttctctgtattggttattctagttatacattcttctaaatgtttttcaatgttttcaacttctttgcctttgatttgaatgtcctcccgtagctcggagtaatttgattgtctgaagccttcttctctccgctcgtcaaagtcattctccatccagctttgttccgttgctggtgaggaactgcgttcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcacttctgttggagtacccggccgtgtgaggtgtcagtctgcccctgctgggggatgcctcccagttaggctgctcgggggtcaggtgtcagggacccacttgaggaggcagtctgcccattctcagatctccagctgcgtgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagttccagcttcccccctgctttgtttacctaagcaagcctgggcaatggcgggcgcccctcccccagcctgctgccgccttgcagtttgatctcagactgctgtgctagcaatcagcaagactccgtgggtgtaggaccctctgagccaggtgcgggatataatctcctgatgcgctgttttttaagccggttggaaaagcgcagtattcaggtgggagtgacccgattttccaggtgccgtctgtcacccctttctttgactaggaaagggaactccctgaccccttgggcttcccgagtgaggcaatgcctcgccctgctttggctcgcgcagggtatgcgcacccactgacctgcgcccactgtctggcactccctagtgagatgaacccggtacctcagatggaaatgcagaaatcacccgtcttctgcgtcgctcacactgggagctgtagaccagagctgttcctattcggccatcttggcttcaagagcgggaatacattcttacatgtggttatgttatacatcattttaataggtatttctcacttgtttttgctaatgacttactacttgctgtttattttatttttattttagactatgaaagtgatgttagataaaaagcaaattcaagcaatttccttattgtagttcaaaatgggtcataaagcaatggaggcaactcacaacatcaacaacaaatttggcccaggaactaacgaacatacagtgtagtggtgattcaagaagttttgcaaaggagatgagagccttgaagatgaggagtgtagtggctggctcttggaagttgacaacaaccagttgagagcaatcttgaagcttatcctcttaaaactacaagtgaagggccaggcatggtggctcacgcctgtaatcccagcactttgggaggccgaggcgggcagatcatgaggtcaggagatcgagatcatcctggctaacacagtgaaaccctgtctgtactaaaaatataaaaaattagtcgggcatggtggcaggcgcctgtagtcccagctactcgggaggctgaggcaggagaatggcgtgaaactgggaggtggagcttgcaatgagctgagatggcgccactgcactccatcctgggcaacagagtgagactccgtctcaaaaaaaaaaaaacaagtgaagttgccgaagaactcaacgttgaccattctatgatcgttcgacatttgaagaaaattggaaaggtgaaaaagcttgataagtggatgcctcatgagctgagagaaaattaaaaaatcattattttgaagggtggttttctcttattctgtgcagcaacaacaacaaacaatttctcaatcagattgttacttgtgaggaaaagtggattttatatgacaactggtgatgaccagctcagtggttggaccaagaagaagctccaaagaacttcccaaagccaaacttacaccaaaaaaatgttcatggtcactgcttggtggtctgctgctggtctgatccactacagctttctgaatcctggctgaacaattacatctgggaaggatgttcagcaaatcagtgcgatgtagtgaaaactgcaacacctgcagccagcattgttcaacagaaggggctcaattctccaggacaacgcccgactgcatgttgcacaaccaacacttcagaagttgaatgcattgggttacgaagttttgcctcatttgccatattcacctgatctctcgcgaactgactcccacttcctcaagcatcttgataacttactgcagggaaaatgcttccacaaccagcaggatgcaggaaatactttccaggagttcatcaaatcctgaagtatagatttttatgctacagaaataaacaaacttatttctcattggcaaaaaagtgttgattgtaacggttcttattttgattaataaagatgtgtttgaccctagttataaaatgatttaaaattcatgatctaaaaccgcaattacttttgcatcaaccttaatatttgaaaattagtaaaattgcaaaaagaaagcccttattagctgttaataaatataaaatatataaaatgtgtgtgtgttaaactaagtgccttgagtatatgaagctatgaaaatgaagacaacagccttactaacattccatctcattattgttataactcctggttccatcataatcttgtttttccatcccaacagaatctgaggtgcagtcatttttgtgaagctgttattttcatcacaatgtgatctatacctaatgattacattacctgtacatctgaagctcgttcgtaaaccatcgtcccctgagagtatacctaacataggaaatactatatatatttggccgctgaagtgctataatgatgccctaaattacatatccctttctacagacataatttgctttattaaaaataacttctgcataactattgaagaataaaacagccacttatgcacaaggtgagggatatctgcatatctgagctagacaaaaagtatgtttgataatctattgtatgttttgctacaaaagcaaagtggttccttatgattggctgaaactctttgagttcttgttctatctttcagcaaatgaagatgctaattgtctttattctagccttttataacattaccttggctcttcaaagtcaaatggaacctggaaaatcgaacttaattccattttacatttttcccttgaccatttcccatggtggggaggtatgtgtctagatttggaaaataagcctgcttagttttttttcccagctcagtgcttagaaacaaccccctctagcaaaaccatgcctaggaaaacaaagtatccagctaggctttcaaggttacttgggggcaagacatggatagttacgtccttggaggaaaataaatacaaggcagtagatccaaatgtatttgtcatgcaaagaacattagctgagagagagcttccatatataggtttgcaaaactgagagcaaagccaaagccattcctgggttttgctttgtgatatagtctccaaatggatactattatgattaatctattctgagttccttaaatgctattgtaacaatgtcaggggccaagttcaagtctaaagtacgtgtatgatgatcatagctgctataatactcataatgctgaagacatagtaacaacaatttataataggagagcagttttgtgcagcaaaatagttccgtggagcagaattagatcatgaaaatgttgcatggtgggcatttagtcgtgaaagtataaatctgtacctaatgattgatgtgaatcaggtttcaaacctattagatgtgccatttaaccaggcaacatttgcccattatttttttgcatgaaaagtaattaccgtatgtttaatagttactgaattgtgactggcaggtgtgccccaccataataataatgatgacaataataatatcttcaacttcaactcactctccacaagtcagggcaaagagagaataaacaatgattatttggcgtgtttgaataatataaaagccagtctaggtaatttaaggcaaagatcactttcaaaagccagatttatatatttttccctcctccattcaaataattgtctcagagtcccatttcaacttattttaatagttacttcctgcatatctgtgatgggttctcaaaaactttcaaaaccactttcacatattccgttacttagcccttaacaacagtgtcgaatagggtaggagagaaacattgttccctgtttttcatttagaaagccgagattcagagaggttaaatgactgtttctactccacaaaaagaaagaaatcagttgaattttctctgataaacctgccaacgttagtgatacgaaagtgaccacaccgatagagtggtgtcactgtcaatattattctgttggcaaacatattgtatctggaagtcaagggcaagaaaagaaagttagaaattgctgagataagggctgtgctaccgaaaaaacactgaaagggtgccccagctagggtctcaaacctatacctctccccttcagcctggtacttcaatactgagtagattatggtgcccattttgagggaaggctagtgttatctcattcagattaagttttgtgttggtgtgacacagatgggtttatataattaatgtcatgtcctagagggctgtgaacattcctacacttgaggcagtgttcaaaatctattactgtttttttttaattaaaaaagaatttgttttctttttcccctagatggaacttaaactcattgtatatgattgaagaggaacaaggagaaggagaaggagagaaacaacatacaataaagttgtccaccaattgtcccaggaaaatttgtttctcacataggggtcatcacaactgctgcattgcagtcagctggaagtataatcttccatgaatctgaagatgtgatgaaagatagtaggcacaggcaaagcctagctttaagaaaaacataaaatgaggactttgagaccctagggcctctttccttcttcttccccttgataggcaaaggcttttttccaaatcatctttgtaagaagtcccagacccacaatgaactattgaaataccatgatccagtaatgtcatcttcttctgctattaatatggtaatcattttaggtgatagatttcaccttcaacagttcttgaagaacattcagacagttcaccctgaaatgggtgaaaaaaaatcaggtacctcctatttcataaggatgtgagccaggatgaagcagtatgttatcaggcttggcatttcgcaagctgagtagagtccatgtgatcaccaggtataatgttatgctggagttgggtttcatctcttgcttgggtttggaatgtaaacaatcttgaaattgtatttggagagaaggaaaccctgggaaatgtttatttttaaaaaacatggattttttacaaaagcaaatacatgttctaatttacatcagggagcagatacctctttacttttttgagatttttctgagacattaaccttaagttatcacttgtgtgtatcaggagaaaagttgggagagtgggagagatgggtaaggaaacatttttaaatgtacttaaatctcccatgatttatttcaagctgtaaagcatttctaaaactcgagtttgttaattatcccaaggaaaaagaagagaggaaaatagtcaatctgatagactggtgacattccatgtagcctgatactaagttgtgacaaaatatctaacattcggccattgtttttgatatttgtactttttcttgtaaactatttgctctgggacaaaaagtcattggttttgaacttgatttgggcaactaaatgatatacttaaccacctgctttagcccgaccatgactttttaatgacttccattttatttggttttggaaattgatttgccctttaaaaataatatcagcatttaaagtaattttgcttgttttttgtttgtgtagtagctaaatatgctaagagaatgacttcaaatatgcagcctttatgaagatgtgaaaattgctgtgctctagctacaaatggcaattccgataacaagagcttgaatgtggccttgaggcaagggaaaaacagaaaaagtccactgaaagtcaactttgtccccttaatttgcaggcactgtggggagcagggaatactccatgggcacaggcatcctcccgagccatattggttgtagtgttgtctattatatctgcacagttcctcctttgattctttctatgaatcatgtgttagcaacccaagtagctgccattagctccagccatatgggtgaaggtaggggtagaggttgcagagcttaaacataggtatccagaaatcattggctcttcccatttcctgactgattctccaactatcaatctgcttgtaagcacattcacaccactcagtgcccctggtacataaaacaagagcagtgactgaaataagctctcaaactagcaaactgaacaagctatacaagacttcttggatattgaaaatactaaacattctcatagctatagaattaattatttggaagatattggcaagtaccttttcatgtctacagtgtccatctattaaatgggaactactactctgaaagtagcagtaagttttattaggggaagggggagaatcatcacaatcatctaaaactgttttgtttaatgttacctgccaagatatgtgtctaagaggctgctgtggctcccaccagccctgacctctgcacatcactgaacctgtatcctactgttaatgatacatatgtcatatttacaaatgcctcatgtgtctcagggtggtaaaaatgtttctattcaagaatggcaactaaaaacacccataggtccatcatattggattaaccacttatatccagctacctgaaactactggcactactcagaaaataaattttcttttaccatcttgcccacttaccgttctcagaaagtcctgcctttcctttcccttctttatccaattaacccaacttttagctcttacatcaaatcttctggaaagccttctagacatttctctcccttcctctctgccattatttctttttcaggataggttagatattatactgggcgctctcatagcttcatgggcatacccatgtcaaagtagccagcaatcgctattctaagaaacttgtctgaatttgtaattggattgtaaatatcttgagtgcaagatcttcaacttgtatagttgtatttccaattttcaacatatgttgagtgaatgtattctaaatataatattaagcatggcctatacctggtaatataaacatggaaatagaatgattatttaatttgtcatgtctgtgaaggacccttgatggtatctagtcttaaccctcaacttacagttgaggaagctgaggaccatagtgtattcattcattttttgtttattaattcatgaattcattcatgcaacacattgcattgagcatccatgtgtgcttggcactgagctagccactgaccaggtaatgctaagtagagcagaacaaaagacatggtccttccctcatagagcttacctcttagtgcagtagagacacagtaatccaatcatcacacaagacatttatactcaccaactgtgctaactggggactatggcagccaactgatgtgaagatttggcttaatggcaggagtcaggaagcctttcctccaaggtgtggtgtttgaactgaaatctgaagaaccagcagaagagcacaaggagggaaaggagtttgccaggcccaggccagtgggtttgaagccttgaggcaggggggaatgaggtgcattcaagaaactgaaaggcggaaagtgcaggagcagaagaatgagggactcaagaagaaagaggcagtacaaaataagaatgaaagatggtcaggggccagttctgtaggacctgtagccatttaaaaatgtttagttattaacttagaacagtgagagcactgaaatgtgtgagggtcagaagaactgggaggtggcctgataacacatgcattttgaagaatctctgctgcagtgtagagagcagattggtggacaattgatggactgagcagataggtgagaggtagccctactgggaagaatatgctgaagtgtgtgcaagagattttggcagcctggagagtagagagcaccactgacctctctgttttttctaactttctcaaaaatgctacgttcacctacatcttatcaaagaaggcctttatttacctatacttctagcatgctttgctttagattttcccatttctcaggtaagggcacagaggctaacgaacgctcctttcctggggccaaagcgttttcagtttgggcatctcagtaacttttggcaccactgctggctttaaggagcctgttatgtagtctatggtggatctgaataccaggcagacagatgacatttttataaatagtgtgaggaaaccccagaagtaatgtgaatggatgagagttcaagaccactgctgacctggaaagccaatgactgaggcaccagaggaagtaggctctcagagggaagacagaacaccccctttccagctcattgagagtgaagcaggtgcttttctgaagcaggtgatattctgaagatccacctcctcagaacaagtgttctgaagtttctctgaaatgcagagaatctaccatatgatatggttttgctgtgttcccacccaagtctcatcttgaattgtacttcccataatctccatgtgtcatgggagagaccttgtaggaggtaatttcatcatggggggcagttacctccatgctgttcttgtgatagtgagtgagttatcatgacatctgatggttttttataacagggttttcctcctttgctcggcacttcttcctgccgccatgtgaagaaagatgtgtttgctcccccttctgccacaattgtaagtttcctgaggcctctctagccctgtggaactgtgagtcaattaaacctctttccattataaattacccagtctcaggtatttcttcatagtagcatgagagcagactaatacaccatctgtaagaaacttggaaaaatgatttgtttagagttccatctgagcagtcatattattagtaagatatatatgtcgggaaaagaaatttacttcttatgactttttacattttgagatcttattgtttgatgctccacgttgagggagccatatttctccacctggtcaccaggctcattaggagggacagatgtggcctcacatttcatgtgcggttcttgtctcagcccttctttttctcaaagattcctgccttttgtctacttttctcaaagtgccatcttccttctctcaggctcttttgggattacccaaccaccattgtaggcaactctagttctataggcaactctagttctataggtaactctagttcagtatcatgactttcatggtttctataaaaattgccatcccacagccttcttcacatctgtgacaggcagttgagaggggactgaggaaaagtattgcccatacatggaatttgtggagactcaatcaatgttacttggattgagtaataaaggaagttatttgtctaagtttgggcagcaagagaatggcagggacagaaccaaaagcagtttttaaacgataatctttttttatttttttactattaaatacagcttgggggcaaagaagagggatacaatttgttgactttcattgctacatttttggacaaggaaagagaaacagagactcaggactgtttagaagtccaaatgctatttatttccccatactacaatggctgttgaaaattctcctataatatgctacaaatacaagtgtattagagagtttattgtgtatatttttgaacatagtgtaatttcttgtatgatgttaatacagttcttgttcttattctctgtaagagcttgtgttgctgttatctctagataggagcaaacttcataaaatgtagaattccctctgcatgcatagggaagtagcttttaaaatattagcctattccattgtttagttataaagtaaaatgattttttaaagtgcaggataagtgaatttttatgtttcatttttagttattgaattgtctaggtaatgcattttaggagggcactgttcctcccagaacttaggaaagcagtcattcaatcactcagtaatttttagggatttttaaaatagatataacaattttaggatgtcaagttttagatgtctagttttaacttgtttggttgagctgacatttaagttcagtcccaatgtgatgtgaatggacctagccttttacctcttctttttttcctcttcattggaaaccagtacagagaacatggtcacttaataagaaagatgtttcctgctttgtttccttttattcaactcagaactgcctgggggaaaagattgcttcctttctgaatgtggtaagccacaaaatggaaaatgtgcacacgagctctttcctattaaccttggggaaaggtgacagaaatgtgtgaacaatgctgttagctgtttaaatgttcttttattattattaatttggtttaagggttttgcctaacaagtaactcccttgatttgtatgtttcagagttgtttaatttttctccaaaataacaatttgtccttttgaaattctttgttagatttatgtcattccagtttcaatcttggtgatgattcttctatctgtcatgagtggtttaatctgcatgtttataattatagcatataaagccacataattcaaggtgggtcttggtatataattcctttgtactttttgggaaaataaggctgtaatggaagtaataaagatacctgagttgggaatgtttaggtatcaccaaatattagctgttcagaaaaatatccatgataaattagaaactgaaatcagcacatttttctggtttcggttcttttggggaaacactgttattttttaattcctggcttaagaattgtatttgattatgcgaagacaaatccaaaattttaaattctaatccaagaccttagataaattagggaattagggaatctgtgtatgtattttataaccatatcaccatatattgacatacctatgtcactgaaggtatattgtaaaagataatttggccaactgtattggaccaactgctcttgaactctctaagtacaattggtttaagatattgcctgaaatgactattttgcttatggtgtcattctttcatggtcaagatgacagttctctaggaatgttatttcatttctagaatgtcagccaaacagctttttatgatcctgagcagttatactctaccatcccaaacacacacacacacacatacatcttacacacacacacacacacacacacacacacacacacacacacacacaaataagccctgagaattttcagagaaattcatggtggaagatctgagattagaacccaggaactcctaagattccttggttttgtatcaaaggtcaataaagagacatgaagtcaatgaagtcaacaactgagggaaacatccctgaggaaatgcataatggaagtgctggtgtaactacctcaaataaatatttctactgaaactgatcagtcatccatttgatcaggtaaggcaggcaagcccacctctgattgcgtagtaattcactgatcattatcctgatttcagtggatctatgccatactcaagacctacatttgtcagtgacctgattgtcttattgccctacacagacatataatcagtccagcctgtgtgaaactccttgtgacccttatcatcatacttaagctgttttggtctttcaaatgtattcgctcttctttaccattttgaagccatcactctttcaccactgccagctagtcttagtaatctttcaccgtgcactgtctgttgcctcactgaatcctcacagtcattctatggcataggtaatatgattgtcattgacattatgttcataagggatccaaggttcagagggattgtattgttcagggttgcacagctaatttctagtaaagccaggaatcaacttgcgtctatatgattccatggtctatgcacttagctgtgatgtatgcgttctatctcaagtgatcacctctaaaatcaggatcagttcacagatatttgtgagtctctcaagagaactagggaaacttctgtaaagttagctaatggctttttaatgttatgtggtaattgtggtgaagcaattgtcaattccagttaaattagcttaaaatgataagagcaaacacatatctttgatgataaggctgggatagaggttaatgtctcatcaattttgggtctctcttagatgtttgaccttatcctaacaacttaagctttaggtaaagtctgcatttggtactctaatctcttcctatcagacacaggtgctcttctctgcccaactgcaattcagtccaagacatgccttctccagttagtctctggagaatgttgttcctacttagactcactgcatagatcttaacttgtactcctgctggtggtgtgcatatatgagctgtcacttgaccatgcagccacacctggagacccatttctaggttcagagtcatctctgatgcagcctgtaatttccccactagcatgccactctgtaggaatgaaccagacattgccacatcattctatgtagcattttcttaaaattagagcttcactataaacaatctttggtcaaggaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcagaaaataagtgggaaaataacaagatcctaggaaatctgttgtatggagctgaggaaaaggaatgagtttaggtttttctttaagttattgaagaaggcatgggattatcttctggttgctagtcttcccttagtttcaatgggaaacttatcagacacacttatcttgcagaagcaagataagaggacaaaagaatttggaagatcatggtggaattaaaaaaaaaggaatgtagtcagatggtaaatttagtctaattatatttagagatgggttaacataatcagaaggtaaggaacccaattatgagataggtgtgataacatagatggcttaataaaatacaaaatagaaagatataaatagaatgcttttatataaattctggaggagtttaaaaatgagtgagtgttcaagataacttagaaggaaagatattaatataaacttgaggtatgttggtcttgaagaaaaatgaaaaagctcattttgtgaaatgagtggaagaataccagctctttttcagattttcaccattttattaatattttttgattatagaattttaattatgtaggaaggaatttattaaaaagtaaacacaaaataaaaccaatcatatagttttggccaaattgttgcttttcttttacttcatttcctaaagggcatttctcagagtcacttgaaagtaaaacttgagagggttttatttttttgatttatttatttattttttttagtggctgtttgttgaaaaaccttgttgtaggctgctaggcattcttttactaagaatttcgaatgcacctcatgtgcaaaagactgcttaagtgtgtcactgcagaaactagcaggatttcaaaatcaaactcatcagttttctgtgataggatgatggtttgggagatactcaagaaaggagtacgtgttagtagctgaagatttttctgtcttcttccttgtgttgtcagatccacacttttattttccttttttttttttttgagacggagtctcactctgtcaccaggctccctgcaatttctacctcctgggttcaagtgagtctcctgcctcagcctcccgagtagctgggattacaggtacgtgccaccatgcccagccaatttttgtgtttttagtagagatggggtttcaccctgatggccaggatggtgttgatctcctgacctcgtgatccacccgccttggcctcccaaagtgctgggattacaggtgtgagctactgtgcccgtccttgttttccttttgtcaagaaagccagacattctgtgacacggtaaatgaaaaagggcttggacccaaccccagctctgttgcttgcttgttgcgttgccataagagaccctcaagaagaatctcacaaaatccactgccctcccttagtctcgctttcccactaaatcgctccatgcaaggggagccatttatattgcattaaacttttctcggtgttctctaattccaggggttcttactgcctgagagggtcactccaccatgtgggtaagcggggtgtccagagtctgcccataggccatcagcatcagtttttcaaatcctgggactttcactaaaaaactgtggttcttattttaaaaacaaaacaaaccaaaaaaactgcaaggaagcaaactccacaaaacccatcaaaaccccaaaattttcttaaccttaataacttgttctttttccatgcatatctaattcctccttttaaaaaatacctaaaaaattgaaattggtttaccacatattcctgttggcccacgacacataatgattaatattttttcctttataaaaaattgattgcttttactgtgacaactttgacaaagtctttcaaagagggagagaaatgtgaattcaaaaggataatgtggcttttattttttttactttgatcctgttttgtgaagcattacctaggttagtattgcctcatgttaatcagtgaccataaaggccattaggatgccttgatagatgcccttggtctcccttgactttgattgaagcatcttaaaggcctgtatgcatgtggcacaacatctaacattgtaattgctcactcagtagctctgagcacttactcttcaataaattcttagatgccgtggggatggcgaatgaactttttaattacatgtctgttgttttctatcaccaggaactaaattaatgggaaattagttcacaaggtttattatgcattttccctctttaagaggggactctttctgacagcccttccacttttatccttttaccatttttttttattggcctcagtactgaaattccttctttcttgttccaactacatcagaaacattcaatagacttagcagcctatgaaagtctgacaattacttcctcacggcagccttgtttcaagagtaggtccagaataaataaaagtttttcattttcctggtggcatctgttagttttcaacattgcccagagaaagagttactgtggaatacaaaaaaatgagctatttttttcttccttttggggagaaacagacatatagaaaaccatgagtgcttccttcataaatcatattttatgtgcaaccagtaagagagagagatgatgatggttgtggaaaagtcatagtggataacctcaatttattcagtcttctgagataatgtaagagtaaagcatggaaacaggaatacagagttcatcataattatagatcatccattcaaaacattttgaaaacagtgctatgtaaacttgggatgacaaataatgaagcatagttaacacttctcattggttgtgaattttcaaatacatccaagtatttaatcatggccattcatcattctgtaaatcaaaactaggtctttgaattctctccctttcctattctcagattaaggcatatttggtttcatataaaatcttatgcataattttgaatttcttgggccaatcaaataatggtacataatttaatttaaaaaacttttcagaaggagaaaactcatgtttcacatacttcttattaatcctaaggcctagcaaagggtacatacagctgtagttcacctcaattatacactgtaaatatttagattagagacacgaaataagttttgggagttgcaagaatagaatcagatgtaggaggtattcttgtagaatagagatggagatgggatttaaaattttttatttcactgctagagcaataaaatcagtattaaaaacaaggagaggctgggcacgatggctcatgcctgtaattgtagcactttgggaggctgatgtgggtggatcacgaggtcaggagttcgagaccagcctaaccaacatggtgaaaccccgtctctactaaaaatacaaaaattagccgggcgtggtggcgtgcgcctataatcccagcaacttgtgaggctgaggcaggagaatcgcttgaacctgggaggcggagattgcagtgagctgagatcagaccactgcactccagtctgggtgacacagcgagactccgtctgaaaaacaaaacaaaacaaaacaaaacaaggaggggcatgggcttggattttcataggaagagaggctgagaagaacaagaatgctgacatttgttttgtgaaatgggtctgaatgcctataaaagactagcaggtactcagacatgcctgtcaccacttggcagcaaagcaaggaaataggacagtattacatttgtgaagttgttgatcagaaaactagtgtgcagaggaatttgtgtgttttaaaatattcccaaagtggcagaatattactgacatttgaaacaatagcacagtctacctatgttaaaatggtatttccatttttaaattatattttttcaataaaagtcttgctctcttcttaagttacagatttttactttttcattttgcttgttcctgtgctccttgatccatcaatgaaaatgtgattttctgttggagtcttcgataaatatgtaaggctattttcattgcatcagaaagctgaaagggaccttggctgatcatttgtgtaattgaatcgtgtctgcgtttagggcacaattttcattttatgaaagaaacacaagatttcccatgatgttttgcatgtctacaaattcaggcgaatgagtctttcctcgggctcagtgagatcagtggggtcatgctagtgaattaactggcatgatatttgcttaacaaaagcatgccataaataagagacttaatagtcagttggcaagttgcttcatgctaatgctgtttttaaaatttaaagtaatggatgaaataaagttttatatacatgtctggatttttgaaaaataagaagatttgaggcatagtgtattatagcagaaatgtcttttaatttatttttagttgttttgggtacatggtaggtgtatatagccaaaaaccacaattacttttgcatcaacctaatatttacagggtacatgagatgtgttaatacaggcatgcaatgcattataatcacatcatggagaatgaggtctccatcccttcaaacatttttgctttgtattacaaacaattcaattatacatttttagttttttaaaaatacaattaaattattattgactatagtcacccagttgtgttatcaaatagtaggtcttatttgttctttatagctatttttttgtacccattgatcatccccaccttcccccaccccaaccctcccactatccttcccagcctctggtaactgtccttctatttccatgtcttttaaagtgtctccctcatttctgtgtacatgtgactcactggggaataaacagggaaatcctttgtgatgaatcagatgtcattctgagacacagagcttcttatacttttctttaaaatcatatttgcccttctagatcagtatcaagcaaataacaaccaagaatcaacatgcataaaaatgacaaggttatcccagagttctagttgtcattttcatagttgccagcacccttttccaggaaaacaaagagagtggccatctaagtgatgccgttgaggaagctgcctttcccctaatttctggagagcctagtgtagagggagaactcctgcctctgggaatatagcttttagggcatccctttatccattctccaccattccttcagtgaaggaaattataaaagcaaaactgggacccaaggcatgctttgagtctctttgcctcagcccgggcaactgtattctccgaattgagttcattaatattgtcttcttaggagaaatattatctttctccagactgggcagggagtctggcttgagaggcaacaataaagaaagaatatgtcttcctctataaagaaaggccactttataatgaatttcctttagatcacgaacagcactgtaagacccagactgtcaacttgtgcttttgaggttaggagctgagaaaactcttcttgattaataattgagacctaaacatggcaaaaaacaggtctgcctcagcacggagatcatgcatcgaggtggcgggcgatgccttcagtgggttctcttttcttcctgtctcctctgcgattatgtggcaagtttagagtcaactacaggaggagtttcagacaagaagcacagtttgatagaaactaatttctggattgtgattgtgtgagacctcctgggtgttcctgagactttcggaggatgattcttggccttgctttgtttttgttcttttcttctttaggttttcatctgaaggcaagtaactcatgtccctacaaggaaattcccctgaggaattagagataagcatgcatttctcaataaaacattttcagaaaaaaagttgctgtgtttccgggagaagcagatggctgctattgagagacacctaggtttgtgttctgggaatctgtctcctactcatgatagcagggggcagattcagatctgcaggaggtagaaataggcatcagatcactctgtcctaaaaaacaaacaaacaaacaaacaaacaaacaaacaaacaattggaagaaatgaattgatcacagaagcatctagagctaggaccaattaaaagtcagttagtttatatgacctatttgaagatttctcaacaatcttgacctattgcttaagagcacaacatttgtagtaaaatgagcctaagttaggatatgacttaagatcactgaccagctgtctaagcttgttagggttacccaatattgtgaaacttcagtttccccatttaaaaatatggaggcaataatagcaattacctaactggttattgcaagcattaaaggaggtcatcaatttctgtttgaggttggaaaatccttcaaaagctttctattcatttgagtaacaagcaaaacattctgatttaatatctgtatgtgcttcagtgtctttgattatcacatttagaatattcaatattttacttgtaatagtgaataaaaagtttgctggttgagagagtgaataaatgggtgaatggaagagtaaataatgactcttgtaacactattagttatggagtggatacacactagaccagtggggctgagaaaatttaaaaaatattcaagcagtagaaatttttacttaataaatattgcttgggaggctgaattaatgataaaaataaatgttttgcatttgacattatctacccaataattcacttctctctgcattctctcactctcttaaagaagggtaccacattgatgatgctaaatgattcttgtagaaccagccagaggtggaaaagaaagtagttctgacacttggttaaaaaatatacatatacataaataaagtcaaactccactgccatctctactcaaagtgtgtgcatactttcttaagtacacgctgagatgactcattttacacttctttttttacatatttaccctgttttaatgggttggggaatggcaagagcaaaggaaagaatagctgattaccattcaagacacacatccaaatcacataaagaaatctttagatctgagaataattgtgaaaagaataccaaattccagtgtagctttaaaaagtgcaccgttatctttaattacctgcttgatagaagaatatttattttggaataagaaggaataatttcaaagttgatggccttgttataaatataagcaaattaacttttttagaaagccatttcgaactccgaagacaccagcaacatttttattgattaattctttagtgttataacaagcaagttgtttttatgccgtatttatgagctggtatataatcacacatctcaggggtggagaggaccttaagaatcatccacttcaacagcttatttgaaatgtgtttgtttttatgttctgtatatattctgttcttttggttatctctctctctctgtctctgtgtctctctctccatgtatgtatgtgtgtgtgtgtgtatgaaatagataatatatataaattatcataaaagtatatttacatatatattttaatgcccactctattggacttgtaagaaaatcttacttctataaagtactctagaggcatatacttgtagcttattttgtgacatatgtttggtcatacatctaataacaaatctttgatcaggagcataattccaattagagcagtggttcttgacagcggcagtgttccatcctaggtattttatacatgtatcagaattttattttatcatctcaatgactagtaaaaggcaaggttgctgggtgccctgtgatgcatgtgacaatctttctcaaaaggaatcctcctgcttctcctaaaatatttgaatgacccactggattttgatgtaggttagagactgtttataatcatcggagcctagattttattttacttaaatcgcagagtactgtttttgctattttaatatgctgtaagttttcccagaaaacaacttgtataaattgacaaaacttattttgttcagaatttttccaggagatgctcaatatttcagaaaacgacctatctaaagacaatagtgtttgtggcatttaagatagaaataaagtacaaaccgtcagtctgcatgcaaactgtagttactgtattctcacgattctaattatgggtgcaggcacccaggactttgctatgttttcaaatatagtttttttctattgctatatatggaaattcttataattttattctgaattaataaccttacatcttttttatgatatacttgggacattatattgatttttaaattttgtatacagataggttgtattatctataaatttcaaatcatagatgatgtaacttattatgtctatgataatgaaagaggcattaaattatgtacgagtgcaataaggagttgcgtttgatagggccaaaaagccctgaaataaaaaagcagtatactcaggggaatttgctacatcttctagtacaagtagaattatggggcaatatactatttatcgattgttatatagtaatatcgccacaaactgagtggcacacatttatcatcttagagtttctgtggttcaggagtctgagtatggtttagctgcaacatctgcaaggctacaatcaagatggtggccagagctgcagtctaatttgtaagattggctgggaaaggatctatttcatgagtcatgcagttcatgtaggaatcgaggtccttgaggcctgttggactacagacctcaacttgttgctgtctgctggataaaggcttcgcttacttcctcaccgtgcagctctcttcagtatggccacttacttcattgaagccacaaagggagaaagtctgaaatcaagacagaacatataatcttatgtaatgtcatcatgaaagtggcatcctgttggcggagcttgcagtgagccgagatcgcgctactgcactccagcctgggcgacagagcaagactccatctcaagaaaaaaaaaacaaacaaacaaaaaaaggaagtggcatcccattatctttgctgtattccattggtgacaagtaaggtatagattccacatgtactcaaggggcacgcattacacaagggatgaccactcacctgcaaggataattgaggaacattttcgattctgttcaacacagccaatttcctatagcagtgttaggtggaggggatgagttattgggatcagaaggtagctagtgtgttctgtagtctttattccaatgaaagataactttacccattaatgtgaagtcaattgtactcagagaagagggaaaactagattactagaatgtaatctgtttaagtcttgtaagactacaaagtccttactaatttgatgtgcatttctctgatgagcatttctgtagcactggagtccagtgatgcagggatgggttatccacattttctgccactcaagatctttccatccaggtgatccagctagttctcaggcccatcaaactttgatccagggtcagatctggaagaggtagagagcatttttttaattccttatttaaaaaatgtgatttttgtgggtcatgtgaaggtttgttataaagataaacacgtcatgggggtttgttgtacatattattacatcattgaggtattaagctcagtacctggtagttatcttttctgctccgcttccctcctcctaccctccaccctcaagtagacctgagtgtctgttgtttccttctttgtgttcctaagttcttatcatttacttccctcttataagtaagaacatgcagtatttggttttctgtttctgcattagtttgctaaggatgatggcctccagctccatccatattcccacaaaatatatgattgtgttcttttttatggatgcatactattccatggtgtatatgtaccacatgttctttatccagtctattattgatgggcatttaggttgattccatatctttgctattgtgaacaatgctgcaatgaacattggcatgtatgtgtcttttccggtgaggttgcagagaaaagagaacccttacacactattggtgggagtgtaaattagttcaaccattgtgggaagcagtatggcgattcctcaaagggctaaaagcagaactaccgtttgacccagcaatcccattactgagagcatttaagagtcaaatgtattcatgacataaatgtgtattgaaaatctgatatgttttagtgattgttttatagggagggggcagagactctgcttttatgaagcttacagtgagtgccagccaccattttagcttttgggggccttctctaagaagggtggagtagttaatgtagacaaacatgggttttggcagcatacgaccatgaattaacattatatttccgcttaccagccgtgtgattttagcttacgaaagctactctctggttgtttatttcttcaagtgaagaaatgggtctaatagtacctatcacacaagattttctgtgaagattttgtgagatcctatatattaagcacccagtgcataggtgttctcaatgttaaatcccctctccatgtctgaaccttcaataaaacagactattacaaattacatatgaagactttgatgtttaacgtcatccacacaaagttaggcaaaagtcatatataacaaatatttaagtaatcacctggaacaagatctctttagttattttttaaatatgagatctcacaattattctcagcatttcctgttcattgttttgctatgggtagcatgtcctgattactcagttatacaaaatatttgaatggcttaaaggagtatttgtgtttgacagcataaataatattgtttttgaaaatgtatgaatacagatagaaatcaatggactggagtatatgcatttgtctatcttggattgatctagtgtattgagtcacaaaatttagttgatagaagggatagagtatgagaaacagagtcccacaactttgcatcaacttagaaaattattcttttatttaacattcattcattcattcatttattcaacatttttaagtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaaaaaaaatactcttttaaaaatattactgctcattgacaatacacctggtcactcaagagctctgatggagatgtacaagaaggtgaacgttgttttcatgcctactaacacaacatccattctgtagctcctggaccaaggagcaatttcaacgtctaagtcttgttattgaagaaacacattttttaaggtgatagctgccatagatagtgattcctctggtgtatgtggacaaagttcattgaaaagcttctggagaggattcatcattgtagatgccgttaagaacactcatgattcaagggaggaggtcaaaatattaacatttacaggagttttgaagaagttgattccggtcctcacagatgactttgaggagttcaagacttcagtggagaaagtatttgcaggtgtgatggaaatagcaagaaaattagaattagatgtgatgcctgtggatgtgactggattgttgcaatctcatgctaaaacttgaatgattgaggaattgtttcttacagatgagcaaaataagttttcttgagatggaatctgctcctgatgaagatcctgtgaacattattgaaatgacaacaaaggatttagaacattacataaactgggtagataaagcagcaacagggtttgaaaggattgcctccaatttctcaagaaattttattgtgggtagcatgctatcaaagagcattatatgccacagagaaatattttataaaaggaagagttaaagcagcaaatttcattgttgtctttaaaaaaacaattagcacagccatctcagacttcagcaaccaccatcctgatcagtcagcagccatcaacatcaagggaagaccctccaccagcaaaaagattatgactttctgaagattcagatgatcattagcatttttagcaataatgtatttacaaattaaggtatgtacatttttcagatatgttattgcacacttaatagactacagtatagtacaacttttgtatgcactgggaaaccaaaaaattcaggtgacttgctttattatgatgttcactttattattcagttcactagaactgaacctgtaatatccctaaggtatgcctatgcttgaaaaatgttatcagtaagatgtgtaatgtgtgacaaatccagataatacattacttttggagaagctgagctgtttcaaaagtgttccttttatttgaagaagaagcagagtagcccaatcaagtaattttatttattttgaacttacacaataatttacgcttttgtttttcagcaagtagtaagggaggtgggttaatctgaaatgaaatgttcttagatcctgctgttcagttggttggagggcattaaagatagttattacttaagatctctgttgttttgaaattcccattttcctctgacctaaattctatgatgtaaaagaatcccagccaccacagatagactgtttttccttatttaaatgctttaaaatttagttttgacggaatggtctcttaatagaattcttgtgattctgtaacatcttagcatctttggttggcacttagaatattctcccacaggcatatttcatttgcctgtatgcttgtattcctcattagcttatttcctctggagagtgagactctgtttctgcatgtaacagttgatcagtaaatgttttgattattactatttagatcctgaacatgaacgggctcctattcctttcctattgctgcccccaatgaatttttacattcaaaaagtaatgacgtgttatcttggtttttgtttctgggaaatattaggaatgctttttggcaaatttcaagggaatcctatttggcattagaaattatttattttgaggcctcgtgtaaaataagcttcaggattttgaataactttgggccctggagagagtaatacctaatgaaaactgcaactcaaagaaataatgaaaggcctctttaggaatcaaggtggtagctctagctcttgaagtcttctaatcaaagagtcaacaaccatttttgatctctgatcgccaaagcaggcctcagaggggtcaactggccatgcagcctgatctcagagtaatggctcctcctatttcaagattcaactcaagcatcaattcctgtaagaaaccttgacagaactgccttttctcccacctccaagtcaatgtgaccactccctttttgccttcactttctctcctgacttgcatttgatcagctaaatttatgtaaaaaaatgaagcctacaaccctaagctgatctgaaacacacagcaaatggaggtagccacatatatatttgataatttcccagtttatagcataacagttaaatcattgtaatttcttatggaatgtatggatcaaacattacatttattctgtattgtgtgcatttggagtaatccatttgacatttttttttacattgtgctagaaaagttaatgaggccactgaagagaaccaaaagtaggaattagaactgaagatacagcaagaattgctaaaagaaaggaaatactgtataaaagagaaaaaagacttttatggagtgattttagagtaactatggctttgtaaaaatgcacatcagtttatcagttttataagccaatgcttggtgggtatggagtttttcagtgatccagtttcaagtaaataagcaacgaataagaagaaattgtgtttctttctagaatgtgttgtcaaccactgaatttaatgctaccaatagatgcagactcatgaagtgcagtatgatttcgataaggcctaagcaattatcaaatcagaaatggatctctcatgctataaaattgtacatttaagcaaataattttaagataattggctttcaaactatttttggatgtatcagaagggatggttgtggaaataacagcacagtaaatgaatagttactggaggacaggaaagcagaaaaaaaatctgaagtgtaaggagatacagtcaagctgtttataaaatacatttagatacaaaagaggtcactgtgtggaaaacctttagaatcactgttgaaagaaaaaaaaatgtccacttcccaatttcaagttctattgggattgtttgtattataaagagttgactaataaattcctgccaaggattatttccctatccaaacaaaatgtccacaattctttatgagagaagatgatacccatagcttctgcttcccgcagtggcactctcatcacatatattggtaagtatagaggtgccaaggagaagcaggcaacagttttctccatagcatccatagtcatgctgttcagcagataagcctagtacagttagtatgtcctgattttttgctaaatcctgggaaaaatgaaaagagtcttccttatgcagttgtgttttgctgctgagttgtgtttgcagtgtattagaagaaatacatgtaggaagcctgttttcagtacaccactgtattactccatggtcttgaatttctgaggtcttaaaatagggttattaatattacggagaaagtcacactgctgggtaatctggttgaaatggagacagagcataaaccaatagaggtgtacacatatactaagaattttgactggttaagggaaacaagaaacaaatgtatttgttttcattagtaaatatgattttttctcaggatatgagtaagaattagtgaagagggaacaatattaaattattttccttagtaaggtaggatattaaaaattaatcccttctatttgtcagttttccatgtccagagttaattgaacagttgtgttaacattaatataacattgcttgctggctaccaacaataatagcatggaagaatgttttaaggtatgtcttctggtagaataactatatcctcattattaacagtgtggaaaatgtagaaatgtagaaggaagcaaataatcactcatccagagatgatccatgttaatgttttagtgtatttttttctatatttgtagctttgccaatttcacacagttactttttaatatatacaccggggttaagtctttgtatgattacaaaataaattcttgttcaatttttgagaaaaataaggaaactatgaaaacagtataaagaagagcatgtgtgattcctagaaaacagcaaaaataatttggaactgcttttaatgacaagggtaggcaatcaagtttgctaaaatgaataggataatcagctccagccataaataaattagtatctttttaatgtgtctgttgtgtgtattctgcagctggctcttaagtaatttttaaaggaggcctgatatgtgttcggagggggagcaacatgattagaatatggtagctagcttggaataggcatcatcaatgattcgaatgcatgctctagatcatgcatgctttggaagctacaaagcttctccaaatcttggagaagcaacacagtgagaaacctgtcactaagcttttgaggattcctatctggaagaggactgttaacagtaaactcaggctgcagttgattttctttccatcatcaacatattatctgggtctagtgaattacaaaccctcctcttggcttaacattctctctgatggctttctgcacattggcttcctcttcttgctatcacggtaattactcaggagacataccataggttttcttgggtttagatcagcttaggaaagaaaagaaaacttaatcagtgaacagatttctttggcattttccatgtaatcctgggacccctgcttgttagttttgtcctgtttcctgttacagaaaaggctgaaaatcagcatgcagatgaatgagatagcagatggttttcccgtgatagagaccaacaatttgtgagatagaatagtaacgacaaacatacataagagaaaaggcagaattagagtacagtattttaaaagctttcaggcgctcaataaatgctcactattgttaaagagagagaaaaaaggaagtcctgtataatacatcaataagattttaattttcagttattattatttgagctttatttcccagctctctgacacagatttaggggtggtgtggatattcttagagtggaaattattgaactcttagattaaaggtactcgagttcctagcttgccctgtaactacacatatagagaagatcactctcgtaggtgctagtaagtaggagataaaagttttagggggaaacacagagggatactcagaactgggagcagtcctaaggtggaccttcaaaatgattcatgtcttagaaaatatgatttaagagaagttaggtctatagggtcattttatctgaggaaagatggctgtaaggatctttaatgataggagtcaaatatatgagagattgttgcaaggagaatgttaaccagctattctacaactcgactggggatagaaatagctttaaattacaatatacagaatttagattagataaaggaagtatgctctgaaagtaagagttgttaaaagttagaatatgttttccaagtaggttacaaaattgttttaataaaattatttgtgtttattcaaaaataatgaaaacatatatattacatatataaatattgatatattacatatcaatatataaacctaggatataaacccaatatgtaattgatatgttacatatcaatatatattatacatgtattgatgtcttacatatcaatattatacatgtgttgatatattacatatcaatatattatacatgtgtttattatatgtgtgtgtgtctatgtacaaaaagatagctttttgacctcaacagcattataacttgataattgtcttattttggaactcacgctgaagtagctttcagatactgttctagaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtgaggtgattggccacaggtttggaaatggctcaggtttgctctttccaaccccttgcatgtcactgcacatttacctccagaagtaaagcaggagaactctgcaaagggaaccaacaatctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaagggaaacagccatgagacaggatttcacaacctctgcactatcaacattttgggcaagatactcttttgttctggagaagtgttctgtacattgcaggatgttaagtagcatgcctggtctctatccaattgatgtcagaagcaagcaacatccatccctggccactgtgaacaaaaatgtctcaatatctagacaaagatattgcagcatactctggaggacaaaaccagcactagctaagaaccattatcctagagaaaatagaaatggtttagagaagagatcttttcaagatatctaccttggtatcctcagacatactgaagaattacagtctctaaaataattttctgatacggaaaatgaagaaatcaaaggacagaaataacccacggaattttaaagtttaattaacaaaattgttgaaaaattcaaggaaaccttccaaaaggaaaagaaagaagaagttataatatgtgaaaaaggggaagagacaaagagaatccgtttaggaagctaagtgtctgtctaataggaattctaaaaccagagggaaaaagcacaataaatgagacaaaataatcatgacatttcctagagttaaagaaaggcacgtcctcagaatgaaaggcccaaataatgttgagaacaatgaattttaaaatacctacatcagacacatgctaatgaaactttagaataccaagacttaagatcctaaagattttgaaaaagaaaaacataaacaaacattctatcataggaatgacaatcacagtcaagttttcaatctgcatcttgaaaatgccagatgataacaggacagtgacctaatgttcggacagaaaacaaacctaataccaaatggaatcaaacaggaaactcagaaatagacacgttaatatgctcaagtgatttttgacagaggtacaaaagtcattcaattgccttttccacaaatggtgctggatgcccaatggcagaaaaaagtaagtcttcacctaagtcttacaccttacacaaaagtcaactgaaaatggatcacagacttaaatataaaatatgtacctataaaaccttttagaaaaaaacaggagagtgtctttcagatctaaggtgagccaaataatgggtcgacttgatactgagatcacaacttataaatggaaatgttgataatttggactttgtaaaattaaaaacctttgccctgcaaaagaccctttaaaaggatggaaagacaagctacagattgggagaaaatgtttacaaaccaaatacttgatctaggactagtaactcaaaagtcaacagtaaaaaattttagtaacaatctattttagaaaatgaacaaaagacacaaagagatatttcaccaaagaggatatacatttggtgaaaaagcacatgaaaagatgttcaaggtcattaaccattaagaaaatgcaaattaaaactacaatgaggtatcactatccaactatcaaaatggctaaaataaaaagattagtgacgagaccaatcgctggcaaagatgcggagaaactggattactcattcattgctgctgggaatgtaaaatagtacagcccatactaggaaagagttcaatttcataaattaaacatacaactaccatatgacccagcaattgcattcctaggcttttctcatagagaagtgaaaacttgtgttcacatagaaacctgtacgctaatgttgaatgttcacagcaactttatttgtaatagctgcaaactggaaacatctccagtgtccactaatgggtgcatggttaaacacattgtgatacatccataccatggaatagtattcagcaataaaatagaacaggcatgcaatggaaagttacatgcaacagcctggatgaatttccagagaaatatgctgagtgagaaaggccaatctcaaaaaattacataatgtatgatctaatttttataccactttgaaaccataaaattaaatgaagaacagattagtggttgccaggggttaagtaaagtgggaggaaagtggttgtggctataaaagtgccacatgaggaatgcttgtaatgatggaattgtctgtttcttgactatgagtgtcaatatcctgaatgtgatattgtgagatgttaccatgggggcaactgggtaaagggcaaatggaatttgtcttatttcttacaactgcctatgaatttacactgatctctaatgaaaagtctcatttaaaaatttgatagtgcttgattttatcagttgatcaagctgctcttagttgaaataacaatttcagaaggatcagcataatgaatctaccagtcactgaaaactctcaattatctgtcttgtcttccctttcagtttttgtttcatttctgttttagtaacctcttagaaaaaggtagtattaaaggagacctaggtctcttttaccaatttaggataacttcacaatctccgcagataaattggtatctgtgtacacacacaaaaataggaaattcttgtgagtagtttacaggggaagtgcttaatatataaacaaggcagtgctctggtaaaattacttattgcattgagattaagaacataataaaattattaaaatagcctaccactttcattacagacttaaaatgttcttccttttatctctgggggtttgataatccctgtttattgttcttttattttgctgtatatcacgttggccatttaatcattggctctttagcagggtgggtgtagagagcattaaaaaataataaatgatgcagtttatcatcacctccctgtaaaacacaaggcacgtgaaggatatgagtttcctttaagctaacgtatttacttaatgtgatttcaaacaaactcctacaaaagtttttggttatggcatccattttggaatttgaaaaatatatataattcatctgaaataaatgtataaaacagctaattttctggtaagatataatatgtgggattatcactactacttttcaaaatgtagtctaaagaatattacttaaatgagctttatgctgagtaaagaatatgggggaaaaaaccctaagagtataaaagcccagaaagagcctcttctacgtatgagagtgtatgtatgatatactatattaatatatgtattgtttaatataacctattttgataaataatagtataatagactatattatatactattatataatatagggaggaaagtaccattaaataaaagatactggagcaactggataactatttgaaaaacaataaacttagaccatttgttgcactatacaccaaaataaatttcatatagattttaaggttaagtgggaacaaaaagatatcacacacaaaaaactgtatctgaaagtaaatatgttctccttatagtagagtgaaggaaatcagttaaagcattcaaataaagagaaaaatgtaaagagaaacattagtatatttgctatataaatggtaaacgttttatatgtcaaaaatcatttgtatattaaatatttatattaatctgtcatatgtggtagatgattaatatacctagcatataacatgctcatataaataataaaaaaatcataagagaaaacaagacaaaagccatatatgtagataattcatcaaatggaaaattataaataagcaaattttgaaggaaaataaaataatatgttctatgattaaagtggtcaatgtctttaaaggctaatattaatagctgacttgtggtctgtaaagaatagtttatttaacatgtgacttataaaaatatataacacttttggacagcatttttagagataaatattccacactttttgtagcattgattaactttattcacatcttaaatacttataaaaatctgaatactactttatttcaatgttatttaaattggtgtcaagttctggctaatctacctaccgaatagtaagaatattgttatgcagatcattgttattctataaaatgcagtaccattcagtcattcaaaaatacatttccaaaaaatgtttagagaaaatgctaaaattatgctaagtgaaaattcagacaatatttaaaattttaatagtctgacagattctgatatagataaacagaaagaaagaaaggtaatgtaattttcatgtaattgtacccatgtatatggggaaaaaaggcttgaaggcagtatacaacaaaatgttaaggacttgttatttgcatctactatttcaagaattccttctgaatataaccaacagtttatgcacaaagaatttaattgcaatattcttaataacggtgaaagtcaaatattcatcaataggtaagtgtttaaattacattatcaaatactcagatgatataattctatgcaggcattataattatgtctttgaagtgtttctgttttaataatatgtaaaagtgcttatgatataatgctaagtaattaaaccatatgaatgtatgttaaaaggctgcatgaaaatatggtaaattgtttgcataggttatcattgagtagtgaaatcataattgctatttctttcttttttctttttttttttttttgagatggagtctcgctctgtcgcccaggctggagtgcagtggtgcgatcttggctcactgcgagctccgcctcccgggttcacgccattctcctgcctcagcctcctgagtagctgggactacaggtgcccaccaccacgcccggctaattttttgtatttttagtagagacggagtttcactgtgttagccgggatggtctcgatctcctgacctcgtgatccgcctgcctaagcctgccaaagtgctgggattacaggcgtgagccaccgcacccggcccataattactatttctttcattatgttctggacactccaaattttcaactacagggtccagcctttgcaatcaggaaaaaaaaagtgtttaaaaacatctctgaggacttacatataacaccagaaggatttatacatttatttagttaatgtggttaataaaaccaaaatattctttaaaccatgtcttagcttcattcttgtctgcaatactttggcactgcctggatttggcatcatgaactgctgcaactaaaataacagtaaggtgcatttatacaaaggaagaaatgagagattaaggtcccctgttaatactaaggagcctgatagattttgatatgttttgtgcactggtatctgtattttcattttattgatttttttctaaggaccttacagctaaagccaggtccccaaagaagtcaggggtttttgtgttacccacaacttggcagaatgtctgcaattactccttctgcttttaactgactttgaatcctctccttttggcttgagtacctggctttcagccaggagaagggaaaatactctatctgttggttttcaaatgtcatttcccctttggctttgttgatggtaaaattctgcctttgcatctgaaattggaaactcttctaatcctggagtctgagtgtaattaatcggaaggctttctcttatctgtgtctaggatcagcctttagtctgatcttcatttttatccaggtgcaaaactcaaatacttttacctttagtgcagtggcccaaattttgtccctagttctgcctgtgctatcattaactgtcattttttaattatatctacacacgaatgtgggccagaggcagcaagatctggattttctcttcctctctgagtccctgacccttggattgttcttccttcttttcaattttggtgggttctgggtttagatttgtagcctaacctagtcaacaacttctttggcatagaaaagaattatttctgatgtgtatattttcccagaagttagaatacccctttgatatatttatttgtgtttaatccacagaaagaatgaagaattaagttatattaacaagagtatcttgcagtatatatatgctttaaagttcacagtgactttgacatgcctctttcatttagttttcacaactcttggaacgtgtttttgcccattttctgcataagaaaactgaatttcagtaaaattaaattgtttttcccaggcaacccagccaggaatcactagtccccctctctcaaaatccagcatttgctcactagaccagagctgctttaaatgacaatagtgtatggaattcattatagtagaatccattctaaacacattgttaatggtttgatcaaacatctttagtagcaccttttcattcatgttttattatgtatgtgtgctacccactttctgtgcagaaatttcaaggaaaaggaaattaggctttctgtaatactcctaatccctgtccttaataagtccaaactctttaacatgatacataagactttcactatccggggaccccagggtactgcaccattctcatccatgtttctcacctctaagcttgtgatactcctgtcatgcagcattttcctttgttgtccaaacgtgtcctgctttaaatgttaccattctcaattctcatctgcctggtgaccttgtgtttcagtggttgtctggagcgttagtgttcattagaataacctggagggtttgttaagacatagcttcttggacgcccacttccaggtttctgattcagttgatctgggccctgaagttgcctttctaacaagtttccatgtggtcctcttgctgctggtctggcatcacactttaagaagtattattctacttatccttcaagacctcaacctaattgatctacagatccttttccaactataggaatatttaattgcttgttactctatgctttcaagctcttgtttgtgtaacatctcacattttttggtgactatttatgagtgtcttctttgcttaactgtcttccttttacaagggaaaagacttgtttgacttgtgtttagatcctcatgggctaacatgatgggaactcatgaagaatttgtatgaataaataatgaacctggaaacctttgttcatttaaagttgcttgtacaggatgaatgttttgcttcattggtttccattattattgtcttcgttcccattcaaattctgtttctaggcaaactggaagaggaaaactatgtaaactgaaaatacaattctaagcctcccaaccatctgagtggaccccttctctcaaccaagggcattccaaagttaacctgaaaaactagttcaggccatgataggatgggggagtaggacatgcctcaatattccctcctcccttctggaactcaggcacagctgaccagtattaacattaaaatagattttaagactgacaaggcagactgtttatagcaataagataccacattccagcctgaatctagtatagtatcacctgacagatagcagaccctgaaagaaatcaaagtattttatctcaaattatggttttttgccatatcttggaatagtcctgcaaatctgtctctcatgaggaaaatccacattctgaagagaatccctttccttttccaggcctctttcctgatccagaagaaaatcaactctgataagaaacatttacaatctattctctctgaagcctgctacctggaggcttcttctgcataatgggaaccctggtttccacaaccccttatcttgacccagacattcccttctattcattctaggtctttagactataacttgactctttcatccaattagaaaatctttgaagctgtccgggcatagtggctcatgcctgtaatcccagcactttgggaggctgaggcgggcagatcacccgaggtcaggagttcgagacaagcctggccaacatgttgaaaccctatttctactaaaaatacaaaaaaaaaatgagctaggcgtggtggtgggtgcctgtaatctcagctactttgaaggctaaggcagaatcacttgaaccccggagacagaggttgcaatgagccgagatcgcaccattgcactccagcctgggtgacaagagtgaaattctatctcaaaaaaaaaaaaaaaaaagagagagaaggaaagaaaatcttagaagcccctcacaccttgccacttcaaattgtccccccttttcaaatcaaaccaatatacatcttacatatattgattgatgtcttatatctccctaaaatgtgtaaaaccaagttgtaacccaaccatgtaaggcacatgttcttaagatctcttgagggatgtgtctcaggctactggtcattcacatttggctcagtctaaatctcttcaaatattaagagtttgactctttgacaactaatacatatatattttaataaccactatgtgccaggaactgtgcttcatatatattattgtgtaattctcagagtaattcccatgacataactatagtacatctgttttaaagatagagaaactgaggctcaaaaagactaagtattttgtaaatattctaagactggaaataatatttgatttcaagattttcttattccaaaatgtgttctgatctgctgctctaccccatctctactaaaaatacaaaaattagctgggtgcagtggtgcacacctgtaatcccagctacttgggatactgaggtaggagaatcacttgaattcaggaggcagaggttgcagtgagctgagattgcaccactgccctccagcctgggtgacagagcaaaaatctgtctcaaaaataaataaatacgtaaatataaaattaaattaactcttgcttgtctcatgacaggtaaagatgatgggacagtggctgcctatcttcagataaaataaaggtaatctccacattaacattactagcagtggttcctgctctcttctttcttttttttctttgcatccagattcaattcctaaattactcccagtatgacagtgatttctactgtgtttctccttcactctctgcagatcattgaagaggtagctgcaaatgcctttcacttgcatggcttttccaaaatgtattcagattggctgaatttctgaatcaaatacaatttattttctctcttatcctagcagaagatttaagcaaagagatatgtaaaatatattaaaaaatttttaagtttccttttttttttttgaggcagggtcttgctctgtctcccaggctggactgcagtgatgtgaacatagctcactgcagcctcaacctcctgggctcaagtgatcctcctgccttggcctcccaaagtgctgggactacaggtgtgaatcactgtgcccagcttatttattctttctttttttttgtacccattaactatcctacctctctttgtcccaactgcccttttcagcctcttgtaaccatccttctattccctattctcatgagttcaatcattttgatgtttagatcaatatgggacttatatttttaagcattttgatttaattttcatccgttggccaagcttggtgttctgcatttgcaaattttgttagggtacagggtagtcatggctgcaatctggagaaaataatattcaagatagtgttccaggacttattattatcatttcttactggtccattggctgagttggaataccagctaatttattagatataccctatgcttccattgtgcaaacctcagcctatacttggctacattctcttgtaaacattttcaagctttttaaaaaaattccaaggttaaatttgagttgtagaaaagaaatatgaataatggccatcataattattccattataaaaacacatacacacactcaataaaatgtgttgttttaaaattattaccctaaggcaagtggtgaatagatccaataaaaataaaagaaatagaatgaataagaagataataagacgaatggaagactacattctttctactgactggtcatcggtttttctaaatcttggtcctttatctccaatgggtctttgaggacaagcacatcttatgtactttgtaaatatttgctgtttatgcacattttgagtatcattgtttagctttgcttttcagatgcatgaaacaagtaaatttgaggcagcaaatgagtaatttgtaaatctagacacaatgagaaggcaattaagaatgctgcttgatgaaaaagaataagagaataatgttgtaggtaagggacaaactaatttcactaatagtggctttatatacagtccagtatgtgaaaatacttaagtaattaacattaacattcacactgtcatcctaggtagtgataagatactggcgaccacacacaaaaatggaatagatatctgtgtctgtaaaactaaaaactcttcaagggagaaaaagctctagtgaaaaatggaattcaccaggaagtcactcaagagaatgcaagtattaaaagcactttattataagataaggatgtcccattcttaaaataatctcctagggaaggcttcaaggatagcattatactaagtagagaagttgtctgacaaataggtaagtataaaaatcagagaacctacagaaaacaaatcattctttgagttgcatgaactttaggaaagagtctttatcagccatgatcaaataaattggacaggtcatataacaagttagaagttgccaaaatttttttatagaagaaacagatgtcatcttcttttgtaaactacatcctgaacatatcccatcctgactgcttcgtggcgtatataaactcccactccacccccttttccccgtctcaagcaagctgacctaccaagctgtgtatttttaatcactttctatagcaatcaagaatttgccatcagagaaactgcttcactgcgtcttatctttccatgcctgttcttgctaaacagatttaagataagagcaactggcagtaagtgcccttcctgaaaacagaggtcacagatgtttctactgaagcccagtaaatggttttgggagacatttgaaatcttagtcatattcaaatcccaaatacaatttctcttttttttcccagaaatttcaaaggttttagaaatattttctactggaaaggtatctctcattcttactcaaaatttagacactaatgagtagatggcaagtcttgtttataagcattaatcatgaagatgaacatttataactgaaaaaagatgttcgaattttggggtttgtaaaagaactaggaatggagaacatttagagttcactatgtggtgatattcacaaaagcaaatgatgatataactatgtcacttggaaggagcttcaggcaggttctttctcttctacatgtaacatgtaagcctgttttggggtcattgctgaggaaaactacttcttaagacaattttacgactgcattgtttcaatagtacaccaaactatgttggaaagttatgacctagaatctgaaaaagaaaaaagtgatgaaggaataatgaaaggctgcatgacagaagtatttagtcttcattcctgtgtttgaagcagaaaaaaaggtattgagggctaaccagactctgccttttgctaaattgaagagtatcacatcaaaggccaaagatccattttaacaggtgccttaaaaagttgtactaaatgatctctgtgcccctttggatcatgaattgtctacataactgcacaacgaatgaacgtaagaaaaatgaattggctggtgaagcctgtctggtaaacaatccatgatcctgagggaattgtagttttgcaaaatattcagcaactactttagtttaaatattttatatgactcattgaagctccaggaagatactactttcttctcaatatcagttcctggttattgtcatcattcctttatcagagtttgtttccttgtcaaatgaactcttaatacatgtatctatcactgacaattttgtagaaaggtcattatctgttctgtttcccactccatgaaacggaacttattccattcaacttcgtgtaaagtcttttcaaatgacacaactgtaattaggaaagatgtcaataactatttacagatatttatgttgtattcagaactgtactagttagagtgtgtggtttaaaaatttaaaaaaaaagtgggtgagatggtgagacttaactaccctattacaccactactaggatggtaagaatttagtaagtaaaccagaaagttattagaaaaacaagtaggagcaaaataagctctgtggcattgaactaagaataaaatgtgaagagaaggggtgagctctattatctacttagggatgccttcagtagaaaatgggacttaaaaatgggcaaaacttaggagggtctttccaggaatgagaatgaacagatcctgggataagttaataaggttggatttattaatcacctgagattctcttttttgattattgggtcatcttgtacacatcaactctgattacaaagtaattagtaatcaataattatttctgcatgtgccactggataaccattcaatacgtaaaaatatttaggtgaaaactttgcttgccaaagtttcaaaagttaaatacttaccaggctattatcactatagaaaacaaaggatgagacgttactatgaaaaggatgggtacaaaagtcatttgaagaagaaacgtactaataaaaatatatttcttaagtactttagtctgcaagtggcataattatttgtgtgcaatatccagaaatacatgcttcttggtgggttttaacagacatatttttacaattaaaaagtatatgcctaatttatgttgtggcagattacatttttcaaagacagttacactgataaatcccaacccacatggccatgttataggtgatgttgacactcctccattgggaggtatggaccagttttagtgactcactttcgtccaatagaacgtaacaggaataatgctacagtccaggtcataaaagggagtagaacttctaccttgttctccctctcatgatgttagaccttggaacacagccacatattgtgagaaagcccaaactaccccatgtagagaaatcacatggaaaggcccacagagagaggaactggggatccagctgatatttagcatcaattgcaaaatgtgagtgaaggaggcttcagatgattctggcctagagccttcaacttttttttttttttttttgagatggaatctcactctgttgcccaggctgaagtgcagtggcgcaatctcggctcactgcaagctctgcctcccgggttcacgccattctcctgcctcagcctcccgagtagctgggactacaggcgtccactaccatgcctggctattttttttgtatttttagtagagacgggatttcattgtgttagccaggttggtcttgatctcctgacctcgtgatcctcctgcctcggcctcccaaagtgttgggattacagacgtgagccaccgcgcccggccgagccttcaacttgattcttccatgagaggccctaaacatcatggcaaagagtctaaccatctccattgtgctctgtctcagttcctgacccacagaatctactagcatagcacctctaagttattgagtaatttttagatagacaataacaagataatatgtcaatctggttttcatatctaaatttatactggctccagatattcacttaagattttatcttggccaggcatggtggatcacgcgtgtaatcccagcccttcgggaggccgaggtgggcagatcacttgaggtcaggagttcaagaccagcctgaccaacatagggaaaccccgtttctactaaaaatacaaaaattagccaggcgtggtgatgtgcgcctgtaatcccagctacttgggaggctgagggaggaggatcatttgaaccctgcagaggatgtggtgagttgagatcacaccactgcactccagcctgggtgacaagaatgaaactctgtctcaaaacaaaaaaaaatttctctctaatatacaaataatatcactttcaaaaatgtatctgctcttctaaaaactcagtttccaaatagtgggctagtcattttgccaaattttagaaaacagttttaaaaaatcacacgtagctccaaatgtggtgcactttccttggttttgttcagtgctcaatacattgatgttgctaaaggccatatcagtgccctccgaccatggaagtttggccataactagttcaagccctgaagaactgaccctgggagtcaatccatatgctgctttgtcccaccaagaagaatctctcttctaagattttgaactaagagattgagagttagagagtagctatcgctgaagctgtcaagatcatctagacttgtaccatctcatgccagtcagatgactgttattaaaaagtcaaaaaataacagatgctggtgaggctacagataaaagagcatacaaattcactgctgcttggaatgtaaattacctcagctactgtggaaagcagttagtcagtttctcaaagaacatttgacctggcaatcctattattaggtatatacccaaaggagtataaatcattctaccataaagacacacgcatgcatatgttcatcgcagcagtgttcacaatagcaaagacatggaatcaacctaaatgctcaccaacagtagactggataaaggaaatgcggtacatatacatcatcaaatactatgcagtcattaaaaagaacaagatcatgcccagtgcaggaacatgtaaggaactggaggccattattctaagcaaactaacactgaaacagaaaaccaaatgctgaatgttcccacttataagttggaggtaaacactgagtacacctggatacaagggaacagtagacactgaggcctactggagggtgggaggaaggtgaggatcaaaaaactacctatcaaatactatgcttatcaactgggtgatgaaataatctgtacaccaaacccccataacatggaatttacctatataacaaacctgcacatgtatccctgaacccaaaataaagtttttttaaaaaaaaataagatcatctagacttgggtaggtggccattgtggacatcatacaagcagaagaagctgatctatggagaagacccataggacagtagtattgagaaagcatagagtcccagagagagacaatccagtttccacagccttgactaatattattgctttataattctgtaaaatttcctctgaagccttccagtaagctccttttccacaaacaagcctgtttgactagcttcttaatattaaaaccaaataatttctcaggtggcaataagggggaagtggagtgcattggtcacacaaaagacaacaacatgaaaatcttaattgttttcagtgtcaaacacttgagtttctggagacaaaactccctcttctaagaaaatcaaactattatacatgataattgtcactttgttagttaagacacatttatacaacattttaagatttggagggtagatactttattaataggtggtatggttctgttcttaagttatgtttctgatttttagatagatcattccctgtttctgtttgtgggaaaaatggctgtctcagtaggctgcattataaactcagttggaaaaaactggtttatttgttgaatgagaacttcatttattttgtgtaaatgagcaccactttttattattcacaggttattgacaagcataatattaagttaagatgcttgacattaaaggattaacatgtacaaatttgaaaaacaacagccgcctagtagacactcagaatttctgttcattgatcaactaagcataatatctctgctctttagcaagtggtttaaaaaattgatggttattagtagtataaatcttggaaaatttgcagagaaaatataatttgtctattctaagtatgttaaatggtttaaatgatatgttaaatagtttaaatgatgaatagcgtgaacaatattagctatactgtattagccattagccttgtaacaaattactcccaaacttaccagcttaaaataacaagcatttattaactcagtttctatgggtcaggaatccaacaacagcttcatggaatgaccccaactcaaggtctcccatgtgactgtcatctagctgttggccaaagctgccattttaaagacatgaatgaaacaggattatccacttccaagctcactgtgtggctgttgtcaggaagctttagctccttaccacgtgggattctccatgtggctatttacgacatggcttccctcagagcatgtgacacaaatgatcagagaaagatctaggtgcatggcctcatctcagaaatgaaaatccttcagttttattgtatcaacacaggtacgatgtaggagggacaatacagtgtgtggaagctggagatggagatccttgggagctgagttggaggctgctaccatagctatatctcttgctagagttcccgattttgcagcctgccatcacctcacctaagactgaacagaatcactgcctagatttacaatatcccagtatattctttttcatgtgcactctcactttacatctcaattttcattccgagcagtacttttaagaaagaattatcttcccctttaatgtgaggaaaaactcccctgtgtataaaaacaaaataatcattcaccatctctttctagtgtgtgacatgcagtgagatttaacttcattgctttgttagaatattctgttctctgtggagggccgtgtttttaaaaaatcactcttcagtttctgctgcaaaaataaaataaaattctctgtgaagtttgtcaagtgaaatggacacaaacatggctcaaagtctagaggaaataaaatgaagccacaatctcagtctatgaaaaagagataagttaggataaaactacagcaaaaaatgtacaggaaaagaatgctgctctttaggagagaaatcagaaaagtcagaagataaaatacagagcaaaaagtttactgatcccaacagagaaacaagaaacctcagagcacttatatgcaaagtatttgcggtgttttggggcccactgactgtaagggaaaccaggtatacacagctttagggcacaatggagagaaagctcttgatatactctcctgagtctcataaacagcaacatcctccaacgtaaatgacagtgaaagaatatgatgaactcctgatgggttgatgccacaggaggatccagccttatttttcctcagctctttcctcaaggaaaagactgggaattgataatactaaattgacaagtccaaataagccttcaggcaaagcagatgatccttttttttttttttttttaagtatccaaaccagtctcagatttcttcagccagaaagcatgtttttgcaggctttttacaaatcctaagcaaagttatgtagttctcgagagttatagaaaaccaggtttgcatcttggctctgatacccctccctgtgatactttagaaggcttacctggcctctaaaaacctccatcttctcatatgtaaaacacaaaaaaccctgacacatagtatgtgctttgtaaactgtagctcttgttaatagtgaataggttttgtttgtttgtttttcccaaaagaatttgatgcttgtgttttgaggagttaaaattctcaatgtaatagaagactctataataaacttacgtcttcttagggtgatacgaaaattattaaactcaatccccctttagttgcaaacaatcaatactcaataatttttttgaattgatgaacctctgattgtgtgcaactatcttaattatgtctatattcttggtcttgtgatgaaaagtatccagaaaatgtctactattcatcactgtatgccttcttctttttagcacagagctttgtacatacgaagttctcaactaatgtctgttaatttaaattgaagaagctttagggagttactacaatttaggtctggaactcacatcccattttccttcttttgtcccacccctacccatttcagccatgcatatgtgtatttggagccctggatcttcaaaaaggcagcaaggagctaattaagccattaatgaattaactttattttttgaagtttataacttatttagacttagtgatctttctttgctcattaacacctctccctgtaggcagagagaaaaaagattaaaatgtgactctgtgaattcttaggcccatataaattcctaagtacaggggaaaagcatcgatttgtaagtcaacatgacattagtcagaagtgttggtttttctttatctgcaggatctgtttccaaacatatttgatacccaggacttgaaactacatcaattatttgaggaatcttgttagggctccatttgtatggagaggtaacactcactggtggcagtggtttgtgggtagaaggggccttcgggtatgtgcggcaaccttgtcaccagaagctgacaccaacaatacacactcacatttaaaaaatgccaaaattgtatccatcacctccaaaattttccttatgtgaaaggttttggcaaatccttgccagattttaaatgattcattctacatttgtatttcacagttataaagcagaactttgcacaacaagttaacttgccaaaatattatgtaaatattgccaaaatattatatcatcaaaatattgtataatatctgtgtattactttttgtattatatatttgtattacataatttgtgtatttatttgctgcttatttaatttataaacataacagaaatataagggaaaaaaagccagataaattttccagaatagatgagaaatggagaaatctgagtccttccttcaagttcattgattatgagttgagtaaccatgatatgctagtatcttttcaaatatataattttttgattatataaagataaggttgatcttcatctcagacaattttccagcctagtagaaacaataaacacagttggattgtaacccaaacttcaactgtaggtcatctcacctaagttagtggatatttggtataatgtttagtaaaaagctacactttgtggcccttcatcatagcaaatattggctttattggcctttaatatcccaaataagaattatcaagaaaataggctccattttcattattaagtatttcagagaaataaaacaataatactgccttaccattgtaggtcattttatagtttccaagggttttcaactatatctttttttaaaaatttgaactttataacatccctttacagagaagacattttacagaggaagacactgagcatcagggacattcagtgactgctggctggtaggcagcagaggtcttgaccagacccctggcttaatcttcagagttcttccatgctgatgcatggaagacttgcccaaggaagttgtctccatatgaaacagccttgaaaataagatgactttcagtctagtttgatcaacatttatgtaaacatgtaattaaaaattgtttgcttcaactcaacagtatgtctctgaatgggaactggttctttctcaggaatattcttggctgaatgtgtctgtgctgtgtcatatgcctcctctttacatatgactgtgggagggtgtggctgtttctataaacactgaaaacagacctgtggctaacaaaggattgtgggtggcagttgcttttagaaaccttggtgaaacttttcaaaagaatgtttcctatcaagcggtgcgttgtacatgtgggagaatccctgacagcacgttgctcttcctggagctccgtgagcatttattcccagtaatgtcctttggtgcttctttccttcatcccttaacgaacctaatccactctagccactcttcgtgatgtgaggtcaagagggtgaacatggcagatgtggcatttatgcgattacattctggtggaagaaaatgggccattaaaatgcaaaccaaaaatcaatgatctgattaattgcagattgtgataactgtaagaaagaaacagagtgccctgataaaaattaagtacgctgacttatttccatagggtttctgagaagatcttcactctggggaaacaatatttaagctgcgagctaaaggatgacgatgacacataggaaagaatgttccaggctacaagaccaatcagaacagaagccatgaggcgggaagaagctacatgtctctaacttctagtcagtatgaccagagtgtagattgagacagacatgcagcatagaatggaatgagatgaaaatggagacagaggcgggatctagaatatgctatatcttgagtcttctaaaatgtgtccagcgtctgttctcagtgcaacaataaactatcaaagagttttaagcagggctatgagtttatctgacatctgttttaagaggtcattctattttatatgagtggaagagacatgaaaaagaccagttagaaggctaccagaacagtccagcagagagatgatgttgggagcaaataaagaattccactgtggaaatgtcacatttgagatgcccaagagacatctcagtagaagatttcaagcatccattgtatataaaaggctagagctcaaaggagaagtctgggtcagagatagatatttcagagttttgaacatatatgtgatacgtaaacaggaatacagattaagaataggggataggatcaaaccttgagaaattcgaatttttaagataagatatggaataaaaagataaaactgtgaaggaaagtcagcaatgtgaagggaagagcaagagtgtggagttgtcaaagagaagaggatctcttgagaagaaaggagtgtttgatttgaatgctgctgagaagtcaatacaaagaaggcaggttttacaacaggaccagcctcataattagtgcatctttcaaggagtgtgaagtactttcttcactgatttctgacattccgatttgtcttactttacttcattgcaccaggaggaatttgaagatccatccaagttgtcagccatgaaaacaaaagtgcagcacgtgagccccagctgtgctcctacctccttggtttggtttccatgagtagttaagcttagaaaaattgtgaagaaacttgttgtgtgggagcgatttttcaaagacctacaaacagaagtaccacttgacccagcaatcctaaacttgtatatatacccaaaagaatatgaatcattctatcataaagacaaatgcatgtgtatgtttattgcagcactattcagaacagcaaagatgtggaatcaatctaaatgctcaccaaccgtagactggataaagaaaatgtggtacatatacactactgaatactgtgcagctgtaaaaaagaacaggatcatctccttggcaggaacatggatggagctggaggccattgaccttaccaaactattgcaggaacagaaaactaaatacctcatgttctcacttataagtgggagcgaaatgatgagaccacatgggcacatagaggggagcaacagactctgggtcttaccagatggaggagggagagaatcaagcaaaataactaatgggtactaggcttaatacattgggtgacaaaataatctgtacaatgaaaccccatgacatgagtttacctaaacaacaaacctgcacatgtacctctgaacttaaaaaagaaactttttctgtatcttaggatcatgagaaagaatcacgttcaaagagtaacaaaattgatattatatttagacagggaatgggattgcaagtgaagaatctgtggaatctcttgatttgtgaagatttcttttagagttcagtaatggatctgtgacatccaatttttctagttaaagagaaagagcattgaactaagaatcagagacttggtttgcagtcccggattcattggttattggttgcttaaacttgggcatgtcacttaaccattctgacccctaatttccttatctgaaaatggtaaaaatcatacctacctgatagacttgttgtgagtgttaaaatgatgtggcttaaaacctagaggaggcattcaattaatgataccttatttttattaatattagcatattgggagtaagcacagggccaaatgcaatcatgtatagaaaagcattccgctaactataaaacattgaataaaatgcgctgatgtgtttatgattgataactgttttttgtcagctttttaattttagctgcaccatcttactttttggtacagatctatttactatctaggagttgtgggggacttggtgggtagccagaaaagatgacagctagcagagcttaggcacaggagcagatgtaagtgcaggtggctggcagtgtggggaccctggaagcagctgctctcagggtaaaatccacgggaggactaggcagggtgagagagcatccccaggcaaagtagagtgacctgcctctgagagtttgggtgtagaatgcagcaggatgactcagaaaagtctgcagagctttagaaatgcttttttttttttttttttttttgatgtggtgtaaggttagaagactagaatgacgtttgtctattattcaggagatgttctttgtaggagaaagaaagggaaaaagaaaaagattccaaatattttagtgggcattatgtagttccgtctcttgctccttcccttaattccccctccagaggggaaacagatatctgtgaaactgaaaagcttgcatctttgtgagatctgctggagggaagctaccgtttaaacccagtctccattattttaaatggttttaagcctcacatgtagtgctatttatttttccttctaaaaaatatttctgggttatgcctccatatacaaaactcacctttgtgccattgtgctgttttgatgataggtaatttagctagatttagctaccatctattgagcacttaaaattaatctctgtaataaactctattcaggcatttcatcatttaatttaatacaaaccctgtagaaagtggatatcactcctcttttgctaattgggcactgaggtttaaagaggttaagttaatttctcagtttgctatagctagaatggaataggtccattatttcaatataggtttgccagactccaaagcatgtactggaactactgtggtataaaacaatatccactccttagaaagatcagcatattcatcttctatgtcctatttataagtgaaccggtgtgctcttccctctttattgagatttttttcaaagtaggaaaaagggaaggaaaaagcatttattgaccacatgccatatgccatatttctttacaaatattttcccatcattcttagaaataaaccccaaatgaatatttttgtccatgtctttcaaatgaggagattgcttagagaagttgaggagttcgtcaaaatccaccatgcttatttattttcttttcatcttacatttttacatatctagtgattgtcagatactgagttatccagggttaaacagaagttacagtctgtgttaccaagggcctcgtagattactggagaagacaaagatgcaaataggcaattataataaaaaatgctacacagacagacaggaatatattcaagtcactcttaggcgcttctcctcccaaaacttaatcccccacttccattacgccatggtgccttccagaattagcgcagtttgcatactgaaggaaactgaggggtggtcagaaacccagtttgtgcaggaaaaaaaattgtggagatcaaaattagcttcagtttttaatatcagccattaattctgaggaacaacttcatccacttaacttgattttccatcttccttgagtcccaaggcaaaactgaaatggaaaagaatctacaggatgctttcatttagcaaagaggcaaacaaacccaaatcgagcagtacatcatagcaacccactaattggaagtctgggtaaaacatctctcatcccatttctaagaacttagctatttatccaaagcaagacctcttgccccctggagctctattccccaaagagaagacttctttaaagagatcgtccttcttagaaaaggagatttttctttcccattcagatatttctagattggttcacgtggatagagaattctatgccttttttagccactgtgactcagatataattcattttgccttaaaacgcaaagcatcagtaaacattgttagcattgttatgtcacccttttttttttttggttgttcacaaattttctttgttaaaatcctgtgcagctttttgaattcacactaaagaactttaaatttccaaatgaagaaatttcctggccagtttttggttttttttttttgaagatgactgctgcctgagtgtcaacatttgagaaaatatagaatttaatttttggaagtcactagatatagcaacctgcctggtgccagagaagagctgtctatgctgtactgcaatttgacttttaatccatcgtagatctgctaatggtatggcacatgtgaagtggtaaattcttgagtgtttgagacaaacattttaaggtacccatacataatgttaagttcacgtttaggaaagtagtaccagttaataagattacttatttgaaaataagaccagtttatttcaatctggatattcgaattatcaaataatctttttttttcaggattttcttggtgtatgttacctttttagtgaaggaccagtgtctcagagctttattttttatggtagtttaattatttaactgaaacctggaagaattaatagggtcagaattttagatcatgaaacatattttattgctcagtggatgatattcttcttggtattatttgctcttccccagagtcaccatatggtataaattattttaaattcccacaattatcagttatgtatatactaataatatcaaaatcatttgtttgggacattttttgtaatttattgaattttcaaagtcaattttgttcagaccattttttttttacaaagtagcttaaaggcacttagaaactgacagtattggatatttcatacgattttttagaattgcagtatctgccatttatctgaggactggtgattcaaaaactctgtttttggttaattttaattaaaaacatgtccactcaaaatactgctcaatacccaaatcattgcctaccttgtatatagttatttttcctaagggcaaaatagctaagaccataaattacgatggcaggcacatggtttgctgacagaactatataaaatactgttttcatcctcatgtcagctctggtacatgcctctttactttaattccttggggaatctgttgtaagttatagttttaaaaaacatccctaccccactagctctgtcagcttacctttttctgactgaccattttatttctctgaaagaacagatagaaactgagttatgtcttagctgaacttgtagtgccctaaatattaatagctgtgaaccagtttagtttaatttggatatttcccaatcttacacctgcgatattgcaaggtagttataaaaagtacacagaattcatctctataaatatatgctcattttatatcctttacaatctgtttcctagattcctaatccaaagaggccattagtaccaatgacatgatggatagagtaggttataatgtttagcagctcattggagatgacatagtttgccaagttaatttacacattttcatactacatatattatgtacaatattttttgtatggtgggttttcatcgagtacccttctctcttgtaagaaattattttttaagaaacatgttaaagagtaaagatgttttaaataagcatttctcaaatggttggtccttactaccaagcatattctggaactgacactttagttttacttacttccagcacatttcatgggaaatggagatgtccaaggaaacaggaagacgttaattgatgatacattttcttctaatattttgatatcccccaaagaaaaaaatagtccaggagatagattatactagaacagtttggctacattatctaaaagtatgttcccatggaaaattatataataggcttagtacattttagaccatttttttcattttctttttttttattattatactttaagttttagggtatatgtgcacaatgtgcaggttagttacgtatgtatacatgtgacatgctggtgcgctgcacccactaactcgtcatctagcattaggtatatctcccaatgctatccctccccctaccccacaacagtccccagagtgtgatgttccccttcctgtgtccctgtgttctcattgttcaattcccacctatgagtgagaatatgcggtgtttggttttttgttcttgcaatagtttactgagaatgatgatttccaatttcatccacgtccctataaaggacatgaactcatccttttttatggctgcatagtaatccatggtgtataggtgccacattttcttaatccagtctatcattgttggacatttgggttggttccaagtctttgctattgtgaatagtgctgcaataaacacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacaatgtaaaagtgttcctatttcttcacatcctctccagcacctgttctttcctgactttttaatgattgccattgtaactggtgtgagatggtatctcattgtggttttgatttgcatttctctgatggccagtgatggcaagcattttttcatgtgttttttggctgcataaatgtcttcttttgagaagtgtctgttcatgtccttcgcccactttttgatgtggttgtttgtttttttcttgtaaatttatttgagttcattgtagattctggatattagccctttgtcagatgaataggttgcgaaaattttctcccattttgtaggttgcctgttcactctgacggtagtttcttttgctgtgcagaagctctttagtttaattagatcccatttgtcaattttggcttttgttgacattgcttttggtgttttagacatgaagttcttgcccatgcctatgtcctgaatggtaatgcctaggttttcttctacggtttttatggctttaggtctaacgtttaggtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagttggaagtcaggtaacgtgatgcctccagctttgttcttttggcttaggatggacttggcgatgcagactcttttttggttccatatgaactttaaagtagttttttccaattctgtgaagaaagtcattggtatcttgatggggatggcattgaatctataaattaccttgggcagtatggccattttcatgatattgactcttcctacccatgagcatggaatgttcttccatttgtttgtaacctctttaatttcattgagcagtggtttgtagttctccttgaagaggtccttcacatcccttgtaagttggattcctaggtattttattttctctgaagcagttgtgaatgggagttcactcatgatttggctctctgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttcctctcctgcctaattgccctagccagaacttccaacagtatgttgaatagtagtggtgagagagggcatccctgtcttgtgcaagttttcaaagggaatgcttccagtttttgcccattcagtatgatattggctgtgggtttgtcatagatagctcttattattttgaaatatgtcccatcgatacctaatttgttgagagtttttagcatgaagagttgttgaattttgtcaaaggccttttctgcatctattgagataatcatgtggtatttgtctttggctctgtttatatgctggattacatttattgatttgcgtgtattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttgtttgtgtctctgtccggctttggtatcaggatgatgttggcctcataaaatgagttagggaggattccctctttttctattaattggaatagtttcagaaggaatggtaccagttcctccttgtacctctggtagaattcggctgtgaatccatctggtcctggactctttttggttggtaagctattgattattgccacaatttcagcttctgttattggtgtattcagagattcaacttcctcctggtttagtcttgggagagtgtatgtgtcgaggaatttatccatttcttctagattttctagtttatttgcatagaggtgtttgtagtattatctgatggtagtttgtatttctgtgggatcagtggtgatatcccctttatcattttttattgcgtctatttgattcttctctctttttttctttattagtcttgctagcagtctatcaattttgttgatcctttcaaaaaaccaggtcctggattcattgatttttttgaagggttttttgtgtctctatttccttccgttctgctctgatcttagttatttcttgccttctgctagcttttgaatgtgttttcatctaaatatttgttatattttttgatgaagggcaaaacattttggttacagtttctttgaatatttcattccacttacgcttttcaaccaaatacaataaaaaaagcaagaaggggttgtcattcttttttttttttcatttgttcttcaatttagcattgaaatattaaatccaaaagacaactacctttagtatgagattgtatattttgaaaatgtgcagaggtttaggtattttataatagtgacaatttacatatttataggaaatatagtttcaaatagattttaaggaggcagctgttaaaatttgacatattactgaaacttaattagtaatatcgaaatatttcagataacacagggatgactgagctaacctgattcaacacatcagttcacaatgttgtgaagaacacattgaacattttcatggaacaatgcattctgctgcttacttcaagaattaggaaggtgaataagatgattcttactctcaaagagcttataatttagtagaagaaagacaataagtctgtgtgcccatacatttattaatacaaggtgggtccgggtcatatcttataatttgtactaagtgtcatggggtagaagagaaaaaaacatttaatgtgatttgaaattgagaatgtttgtgtggatatgtattttatataagatacttataaaaaactaaatgcatcaacccacagattttttgtcttatggcctctgttagaatggtagaatgggaagaactatttgggttgttatatacacaggcctagttattattcccttgagtaaaatagggctttgttacagctaacctaataagaatatttcagtaatcaaatatttaaggaacattgttgaggtggcatggaaagtcaacacaaaaaaggaattccacttgagctgtaattttgttttatttgcttagcgtagattagaattgtgatacttgtactgttagttgcactgtacataaatattttgaattactgtcgctgattggaactaccttcgtgctttaaattaaaaaaaaaagatgtatctgtacattctaaatagtaaaaactctttttggctcaaatcttttaattctgaaggaatatactggcagatacttagtagacataaataatcattaatgcatgtatggtgtatttcattcagtagtaccaaaatctaaaacacattgagttgtctggcatggtttcattgccaaaagttgtgatgtgactctgatgtaacctggtttgttctgaacaactccaaatggttcttcagacttgcccaggatccatctggctcctgggaagccttatgttatcatggctataatcccagactctggtgacagtctgcctgggttcaaatccaggctctggtactcactatctgtatgaccttgaggatgttggtttgtctgtttcccttgcaaaataatgaacattatattccctatctcaaagggttgttgtgaggatactctaagataatgcaggtaaaagtgggatgttaacagcatttggtaagttgtaaggactcaggtgctggctatgtaaaaataaacttttttaagatggatagatacatagatagatagatagataggtagatagatagatagatagatagatagatagatagatagatataaaaacctatacctgaaaacattattttcataatatttcaaaagcttctattgtactatctatgcttttatacatagtaaaagcagatgacatgctggtcctactaaatttacaggttaatttttagatagttactaagaaatcaaactgtgtggaattttctggtacaaaattacaatatgcaataccttcctactgaggtacccattactgaatatttcttttctatcatatgtgaaatgcatcaattttaaatatttggagacatacctaatttaagtgaaaatctcggtatttcctgaaagtcgccacactataacagataaccaatcaaatttgtctagcttataatgtctgtcagcctgggtgatgtggatgggccactgtgttctcaactgcactgtctcagtgattggagccagttcatgaagcgctacagcctgtaggatgccaaggaggttctttttcgtaatcacacacaagcaatgtggtaaaaccctcaagggatagcagttgctttcacaatctatttacacacatacacacacatacacacacacacacacacacacagagttctttgttattttacatctggcaacaggaagagcatgctggacagacctctggcatcataaaccatccttccctctgacctctgtgtgaatcagcagactatgatctctgcagaatttaggattaattgcagcaaagaaaaagaacctctctgaaatctaaaatgtagacttggtcattagttcattttgcatgctgtggaaactatatttggcatcattaacagctgcttccatgagatgttgagcactaaaatatgattggtgaacactcaggattttattttgtggtattggttgcaattatggagatgttgatagatcaatttccacatcatctaaacccttaactaagaaataaagtggtacataatatgcatgtcccctctatatgagactttgttaattttcttaatttaaaaaatttttttaattctatgaaggaaaagaaatttctctttcagctgatgtttccctgaacacacattgtgatcatttactatttcctaagtgattcaagcagcaatcttgttttagaatatttcaactgaaatgccagccctggaatttcagtgctgattttaggaattattctaatgacttcttgacaagctttacctacatcaggagcaagtgaacttggcagagttgggataggagacttgcctccaaaatgttaacttatatataaccaccttgttatcgcattagttgttttcatggtggctgtggtggtcaatagcagaggcaatggaatgagctgtaataagagtcagcaaatctgagtggacttggcttctcccgtttgccatggtgtaaatatccccaccatgattgttttcaggctaccaacatgatgtcactaaatgtggaattgagaagggatgtccaaaatatacatcaataaatcagccctcatttgattttcttctcagtgaactatgtggttaaatgacttttatctacctttatctcgccattagcaggagacattatggaaaaatataatgccataaagtcacctctatgtcattgtccttgttagaataaaaattaagacctctaggtttacttttatgggttgagcctttgacctatctgtggaagtggtaagctggaacaacaaagaggaaaatgagagtctgtgcttttaggcaggtagttaatgaaggaccaggtaggaatgaagaagccaagttctagtccaaattgccattgattatctagaagattttggacaattcacttcatgcagtagctcaacatccatcaaagagtttttgaaagtctattatgtgccaggtgttggaagatgtgaaggtgaacaagcagatgatttcaccttaaaagagcttgtagcttagtgggaaggaggaaaaaaaaggaagtaataataacaaagtaagaaaagagctagcatagagctggggaagcaaaacacacagaatgaaagtggaacctgatcttgcagagtcctggaagggttctgggaagagatgactgtgtgctgagcaaggaagaatgaatagaaagtaggcaagaaggaagggtgagatgagaggcttcttgatttgattccagatctcaggttttatttcaccgttaagtatgatgttttagtctctcttttcttttttagaaaccttcactatgttaaaaaacagtttttttctattttttaattggcaaatagttttttttaaatcacaagtaagtattgtgtaattgtgtcagatttttttctgcacctattaaaataattgtataggttttcctttattctttaatgaggtgatatcatatcaaatattagaccaatattatgtatctgaaaaaatatgcacacacacatataaatgagtgtatttgtgtgtatatgacttttgagaatacattaatgagagagattgtactgtaagttttttctaataatacccttgtgatagcaaggttataatggccacataaaatgcattactaattgctttttatttctctttcttggaagagattgtgtatgattgctgtaatttcttccttacgtatttgggagaattcaccagtgaggccatcttggcctgaatttctattctggaaacgtttaaaattactggttttatttatttaaaagatttagggttcttcagattttacattcttctcatgttaactgtaagttacagtttttctttttttttaatgtgttgttattattttttgtatatgtccatagggtacaagtgcagttttgctacactgatgtattttgcattatggtgaaggcagggccttcagtgcctccatcactggaggaaggcacattgtacccaccaagcaaccttccatcatccactatctcccacccctcacccctctaagtctccattgtccacacattcatgatggacagtgtgcactctgcttccatgtgcacacattatttagctcccatttataagtgagaacatgcagtatgtgtctttccatgtctgaattattacacttaagataatggcctccagctccatctttgttgcaagttggtgtttttcaaaaaatttccttatttgggttgggcacagtggctcacgcctgtagtcccaacactttggtaggccaaggtgggcagatcacaagatcaggagttcgagaccagcctgaccaatatggtgaaaccctgtctctactgaaaaaaaaaaaaatctaaccgggcgtagtggtgcacgcctgtagtcccagttactcaggaggctgaggcaggtcgcttgaacccaggaggcagaggttgcagtgagctgagattgctccactgaactccagcctgggcaatacagggagactccatctcaaaaaaaaaaaaaattgcttatccattttattcaaattgtcaacttcattgacataaagttactgttcttatctttttgacatctgtaggatctctatcaatatcccttttgtttttatacctgatattggtcattcgtgctgtagtttttttcctcaataaggcttgttaagagagttttaattgtattagattttcccaagggcaaattgctggccttgttgatgttctctattgtacacttttttctgttttataaatttgtgccttttttttttcactttttctcatttctatttcctttgggtttgatttttcttttttgactttttgaattagagtatagattattgatattcaactttcttcctttctaatatatgcatgttaggccgtaagtttctctttaatgagtttcagctactttccctaggttttgacatggtattttctatattatttaattcaaaatatattctagcattcattgtaatttttctttaatccaggggttatttaaaaaatatgttgcttaaatttaaatgatttgaagattatgtagttatttttctgtatttgagttctagcttaattctaccgtggtcagagcatatggattgtatgattttggtgctttaaaatgaacttgttttattgcttatcatatggtccaattttgttaaacattcaatttgccctgggaagtaacatgcattttgcttattttaaaagcagtgcattataaatgcaaattaaggcatttatatataatgacatatatatgtgtgtgtgtgtgtatacatatatatgtatacatatatttgcttttgacttgtttcctcagctactgggagaggtatgtcaaaatctcaaactttggttgtgaatgtactattctttataaaatttaaaactgtgttattaggtctataaacattaagaatgtttgtatatttttggtgtaatgacccttttatcagtatttttttcatatttatctctagaaatgctttgaagcctaatttgttattaatatatcaataattgtatttcaaactagattattcaattcatgtaaacccgatgtagttaatactttatgacaaatttatcgtgcttgagtttggtcaggattctcaattctatatttgatgtcttttatcaagttttgtaaatacttggcctggatatactcaaatatttcttttatctcaatctttatctctccatagcttttgggattctaattacttgtgtcttattcctttatgtcatgtctttatgttcttttctaccatttttatttttttctcaatgttttcatccagaaatttttctgacctattttcttattaattaatcttcttcttctgtgtcaattctgctatgaagcccgtccactaggttttaaattcaattatagaactttctgttcaaaaatttccactttattctttatcattgattttatttcactggtaaaattatctgtctggtcatctttttaaaaagtaatatgaataacagttatttattctaaaatccttatgtaactgtaatatttaaaccatccaccaggtccatttgtgctgagttttctcctggttttcagtcatttgattttgtatgtatgtatgcttggtaattttggattgggtgtcagaaattgtgtatgaataaaatgtaaaggttctggatgatgatctgttatctcagagaggaatgtattttcttcaggaaggaatttaagtacagatagaccagcttgatgcagttagaaagtgagacgattcaaggttttattcctgtcattctgacagcttgttattttcagtttctcctttgtcctaggatacagcccttcagaggtctcaaatgaaagacggggccttttttctttataggtcccaaactccagtttttgtctttcagttccattaaactatggaaagctctgagctactgttttctgttcagcctgtctgccccatcctgcttgtgaataagcagttgcctcaagtgaaataattttcctgctttctggatcttggtctgtcaagttctaactgtcttaatcattcctcagtatcttcaaacatttcccctgcatttatagttgttataagtactagtatgatctaagctattctgttatagctggaagcagaaatgctgccatcgaaagagattaggcattggaataatgtgatctgatttgcattttaaaaagatttttctgaacaacaatatcctcatatgtgcaatgaaacattttgataaaaattgttctctcaggcccttttcagctccaatattctgcaagtcttgagagtactaatagtgtgtcataccatgatttcaagctgtcaaaaccccagggcttttagttttagtaggctaaagttagaaaagcttagactctggggaaaatggccaagaagaagactctcatctttggtgtctttctatgtggcttcatcactgtacttcttgttagctttcagcaacatcctctcttttctgggtcttggtatctgggcacctagactatttttccagtaacctgaccactctctcctcatgtggtggtgccccattccacactctcttctaaaatgtttcatacttgagatttaaaattcactgtccatcctgcatttttctgattttttttagtaataaattaacatttattgggtagttatgtgccagacactgtgctaaacacttagatggaatattttattccatattagctctatgaggtagggacaattattatccccatttacagatgacaaaattgaaagttaggggagtcatgtagcttacctaatgttacagaggtaaagtggctgagatgaattctgatccctggaatgggcatcatttagaggggtggttcccaaaagccagtccacagactgtcttgttctctaatatataaaaaataattcagcaacatctaggagcataaatccagagattctgaatcagtagttcttggatggggcccagaaatctgaatttttttttccttttcaatgattacattttagtttactgtacaatgaaacagagaaaactactttttttttttttttttttttttttttgagacggagtctcgctctgtcgcccaggctggagtgcagtggcgggatctcggctcactgcaagctccgcctccggggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctacttttttttttaaagatctgagagtgtgaatcttccacctccttttcaaccaaagttgaggaatttgtcctgctataatctcaacccttgagtatttctttttttaaaaaattttattattattattattataatactttaagttttagggtacctgtgcacaacgtgcaggtttgttacatttgtatacatgtgccatgttggtgtgtgcacccattaactcgtcattcagcattaggtatatttaaaaaaaaaaaaaaaaccttgttatctcagtatgtttttattatgcaaatttcctctaaataatgaaagctcctttttaatgttatattatgatagcaaaaggtgtgctctttgtagagttagcaggatatggttgtgtgacaaaaagccaaatagtattttaggctccaatgaagaggaatatctgtgaagggggtctttcttggtatttttgaagttccacttgaaagtgctgttggccatcactaatcatgagggaaatgcaaattaaaatcacaatgacataccaccttaccccccagccagaatggcgattagtgaaaagtcaaaaaacatagattttggcatggatgtggtaaaaaaaaaaaaaaaaaaaaaaaaagatgtttatacactgctggtgggaatgtaaattagtacaatctctatggaaaacaatatggggatttctcaaagaactaaagacagatcaaccattctatccgacaatcccactacttggtatctacccaaagggaaggaagttgctttatcaaaaagacacctgaatgtgtatagaatcatcctaagtgcccatctactgatgagtggataaagaaaatgtggtgcgtgcatgtgtgtgtgtgtataccatgaaatactatatatatatatacacacacacacacacacacaccatgaaatactattcagccatttaaaaagaatgaaataatatcttttgcagcaatttggatagaactagaggccattattctaaataaagtatttcaggaatcaaaaatcagataacacatgttcttacttatgaatgagagctataggtatttaaaggcatccagggtggtataacggacattggagactaagaagcggggaggctgggagtgagggtgagagagaaataactatgcattgggtacaatgtacactacttgggtaataggtacactaaaatcctaagcttcaccaccatacaattcatctctgtaaccagaagccacttgtatccctaaagctattgaaataaaaaaaatcacaaagtgctgttgcctactccacagccatgcaagtttgattctggatctgagacaagctatgatcacattgttgtagagaactgaggtccttggaaaataaaacacaggttcccaaccagaagttaattttattctgctgttaaaatggaactatgacttttcttatttataagaactgtccttcctttttaaggttaaaacatgttattttattataatgcaaataatattcattatttaaaaatagaaaaataagaggcagatgtagttctagctcttaataaacctggctaaacttttacaaatttcatctgatcatttatatacttttctacatgattggacttatttataatttggatttttgaatagtgctttaacattttttacttaaattgtatacattttatagattatctcttgataagcattattttaatgatatatatgtataaataatatatattcttacataatacacacacatgtctatgtaatgacatatatataatattttgcaatggtgcatatgtgcttgttcccttaagatggatatttatttgactgttttcttattgttggattattttgtttcataaataacattctatgctgaaaatatttttaattgctataaattgcccaactaagacatataacttcctgttatcctttcactacctttgataacacactaaatttttctttactatatttcattcccttcttaatctcatttctaaaaactgtatttctgtcttacaatatatatatcattccttcagtactcctacctgttgatcttctcattgttatttactggcttgtcaggtcttggaagataggcttctcatacaacccaagcctgtcttttgacctgactataaatattttattgtttacatcttcccctgcaaagaattcctctaggatctgcccctttcttgttctccaggcagtatgccttggacattctgtagctggctgggactgattccttgccaggtcagtaggacagatgtgtagactaagaaattaactagtgagttcaagtggaggttcctggcctgttggtgcctgtgaacaggattcttttgagtatgattagtgacatgaaggtcctgaataatatcgtaggcagaagaagtgccattactactcacagtgtaagaagtagcttgagttaactggtgaaagagctaaaagtcaatgaaaagtattgaacttttaaaatgtattatctattgaaaagtttaaaagatcatttattgattaaggaaattcctttgactttaatagctgtgagctctaatgggggctagaaactccagcaagtggtacagtttctagaacctagcagataatttttcattgactagaattccatgtgtgatacaatgatttggcaaagtaaatcacaataattattatgttcattgttttctcctttgtttaccttgattaaccatctttggtgattgtttcataattgttgctttctaaacaactttattgaagagctacaaatggctagctcttctcaaccctttaattagtgtctgggatcggtggatgttagttgaggggaaaaggttattttaataatttaagacaaaacaatttagaaattgtatttttttgaagacaacttgctatgtaaccttttataattccctgaatttttctgaaattgatgttttctttagtgtatagcagtgatagcatgaaaccaccactgacttttttagggcaacttgctggctaattttataaaatttgaactgcactatatgaatgaagaatcatctgtagcaattgctcttttccaaatgttcttttgcttcaaatgccgtatctgaatattagattgtttctccagatgttacaggctcatgtttccttctgctgaattcaattgttggttcctgcttatgtttctcaggatttgtatcatttctctgtcttaagtaaggtttttataaatgctcatcaatgttgtagagtttggattcaattcagatagaggctatttccaccggacttttgctcatctacttcctccctggagaatggtgaaaaacagtcctcttttccctcctctgatagggtgatgggctactattgctttctctctcctaatatattgagtacaccgacctctcaccgaaaccttaggtcaaagtgagaagaggtgattgtttttaattggatgattgctaccatatacttctcttttggtgggatcccaaaataaataaataaataaatgacactccccccaaaaaagaggaactaaaaaaaggctgagaaagcatgccatgaaggtccaggcttggacaacaagcataccatgatgtgaattttagccccatcacctactaactgtgtgaccttgggcaagcttttgaactcaccagggcctcaatttcctaacctataaaatttttgtgatcattattataattacaactaagaataagtaccttatcgttttgctgcaatacacgcgtgataattgtcctaaagtgcttagcatggtgtctagaacgtattatgtacttaataattattgtctgaaaaaataaacacatgaagaaaataccttattgtcaaagaatataatactgtgccccaacttgtgaaagattaaacctcttgtgtctccaggatttctaatagcttatcccagaaaggcagtgcagaggacatgtgggctctcttcctactgcagactcgggctgttctgatggtggggtccaagggcagccttgcttctgccatttgctcagttgatcttgtgaacagctgcggttcttgctgtaactacttgctcgctctcagtgactctgtactgtaaatgtttcatgtgaaggagcactgctctaaaacaaagctggaagacagggaggcaattgccagagctgtcattgtgctgagtcagggaaggcttcagcaatcatccaaagagatgtggcatttacacctgcagctggatgggttatgaacccaaataggtccttaaaaaggaaggctcatctcctttccccccaacagccccccacccactcaatttttgcctactttaagggaaggtttttggtaactaatttttcatctgctcattagagcttaccaattacagcatgtgttacaaattataggttccaggactttgggtgaaatatgcttcgtaaataatggcatattttgctgtgagcagtccttgattttggactcttgcattacctttcatctcgcaaattttccgtataggaatacttggatgtacaaatttcaggcaagtatccgatgtatcttatagaatcagctacccgacaatattgtcaaaaagagaagcaacgctttcagatgatgtaagcatagaatcaagcaaggagttggttgaatccttcttgtgcttttcctttgagatcaccttatttcagaatcctaggaggattgaaacattcctactttgatattttcctctggagatcacttgttaaaagtcgtcaggagtgacatttactagtcttgtattttctctggtcttaacttgaaaagttctgctcatcaaaaatgagtatgttgagatgatattttctatagaaattttgtattttacccccttaaaatcctcacttttcacatgaaagtgtatgctcagataaaacaagactcatggagagcacatgggtgagatcatgctaggctctcattgctaggctgagatttgcatttttctgaaaatcagagtgctgaattttcttagctttgaagtagctaatgggacagtgtgtgtatatgtgtgtgtgcccacttgcatataattccgaatcacttgtttatgtgtagtatatgattctatgacaaagagctccctttaatgcaaatgtaaggcattcatgagcatctcatgtataagctcatattttgaactttgtttttcttttactcaaagaatttacaaaatcattttgtggtttgaaaagtaattcagatttcctataaaatgttatataaaattttaaatttagattttagctagcaagtattggcttaactgtagaaagaacttcattttctaggaccattcaatagtctagcttctgctttatgacaatctactcgtgttttttaaaggataataatattaaaacatttttataaatctcacaataatgctttatgtatattaactcatttggtccccacaataaccctgatggatgtcattattattatcctcgttttttttttttgagacagagtttcactcttcttgcctaagttggagtgcagtggcaccatctcggctcactgcaatctctgcctcctgggttcaagtgactctcctgcctcagcctcccgagtagctgggattacaggcgtgtgccaccacacctgtctaattttttgtatgtttagtagaaatggggtttcatcatgttatccaggctggtctcgaacccctgacctcaggtgatccactcgcctcagccttccaaagtgctgggattacaggcgtgagccactgcacccagcctattatcttcattttaaatatgaggaaactgagacacagagagagaatatacattaagatcagaaagctagaaagtctaggaactaagattcagaacaaaatcatctgattccactctctgtgctcttaaatacttcactagaataagtcttattttttataattgatacaactggtctaaatattaatgaagttttaagattcaatttacatatagcttctgtctctgtaagttaccagttattactacctaaaatacacttgtagtcaatagtaacattgaatattcctagattttattttataataccaaccagaataggaggcctcaaaacacctgtgatggaaaaaatgcagtgcctgagtgcatgcagctaagcctgatcactagaatacatttcatttatattttataagataccaaagacttcagaactacaaagagaactatagttgctgcaaccagaaacctattcacatatacgtacttttataaatcatgtgcatatgtgtgtgggtaccttcatgtgtgtgcatatataaatacatctaaaagctgagaaccaccttagtctggggcattaaaattttagtaaacttttttgatgtatatgttgaataagttgcaaagttgaagtctgttccctgcctccatgtggcttacgtacacttgctaatgagaaaggagcttattacaaatattcatagatgtgatatatatgtgtacatgtgtgtatatatatgtgtgtgtatatatacatatatatgtgtgtgtatatatacatatatatatctttctccccctacacacacatacacacacccctttattcgctctctttttttttttttttttttttttagttggagtctcactcttgttacccaggctagagtgcaatggtgcaatcttggctcactgcaacctctacctcccgggttcaagcgattcccctgcctcagcctcccaagtagctgggattactttctactatacaaattttactgtcatagacattggcttttgtacctccaaaatgtttgttattatccacggaaagggtacccacattttacttctatggataaattacacatatattgactgatagctactatttaatgaaactttttttgtgtttcagggtctcaactctatctttctatctatctacttatctacctacctatctatttttttctcaattaattccagaatgttaaatttcatgatggcaaaagtcattattaattttgttcactgacatactaagcacttaaaatgctgcctggcacatgtagagactcagaatatgctttcagaattgaatgaaaatatcttgacaaggtagcacagtttttgcttttgtttttgttttaatagagtcagggtattgctctgtcaccccacccaggctggagtgcagtggtatgatacagctgactgcagcctcgaactcctgggctcaagcaatcctcctgcctcggcctcctgagtagccagtaccacaggtgtgtgccaccacgcccagctaagtttttattttttgtattttttttgtttttttgagatagggtcttcctcagtcttcaggtacaatctcagctcactgcaacctcaacctcctgggctcaagtaatcctcctgcctcagcctcccaagtagctaggaccacagacacacaccaccacacccagctaatttttaaaaaattatttttagtagaaatgaggtctcactattttgcccaggctggtctcaaactcctgtgttcaagtggtcctcccgcctcagcctcccaaagtactaggattacaggtgtgagctaccacacccagcctaatattttattttttgtagacacagggtccccttatgttgcccaggctggtctcaaactcctgtgttcaagtggtcctcccgcctcagcctcccaaaaggttgggattacaggtgtgacccactgtgtcagcctctcattgttttccatctgacaggtgagaaactgaacctcagagagcatggattactgacccagtatcacagctagtgcagtgcagaagcaggagtggaacctccatttggctccactggccagactccctatctgtgactctgtctccaagaagctcttcgaggccagacagcagcatcttctggggtcttttaggtcacaagtatccctggtcttttcatgactacacatttctggctgactttagagctctagatgtttttctcctatgttgatctaccccgtaaggctccatgagaggcttggactattgtttcacagtaggcttcctaagacattttgcttagctccttgaaggcttccacctgctcttgagcttaggaggagaatatggcctagtcaaagagagaagagcataatagcagataggagtaagtgagcaggaaacacagagaaatggtgaagaggaggaaagaatggccaatagaagatggaaaggcagcagtcacggtcacaaaaaaagggtccagaaacaatacaggagatgcacaagagatttcattgcttttaagaagtgttatgctaaaatatcttcctctatagggaaaagacaatggcaaagaacttttaaaatttttatttggctacttctatttaagtattaagtatatcgcggtgtacaataaatgtttacttaacaaaatacataaaactctttcctgggctaaaccttgaaagacagtcatacatatttcataagttttttgttgtaaaatatttgatgatttcgcagttagggggtttcttagaaagtgctatacataatcagatataacctttccattttatatttccttgtgtaagcaccatgacttctagtaatcttgagtgtctccccttttcaattcacttaggaattttgcatttaaactattgcccttgtttagggagaacaaaacaacacatccaaaaaaatgaccaaatgtgtacaacctggtattacatttctgatttacataatttccacctcagaaaagttttcttaaatacaaaactcactcactttattttaatgcccgaaagaatagcccagataaatggactccaaatttgaggcctgagtaataatgcattttaggattagactagtcatccttgctattttcgtggtgttcatcacgtacagagtacaacaagatactctattatcccttcaggctgttggataaatacaaataagcacatacaaccaaaacaaatcattgtatctgtgaattgaaatgcatgtcataagaactttaatctggtgcaattgctcttatagccaagtaaatatagtcagcaaagcttaccttttatgttaagcattttacagattacatatgtaagataaatttaagatttgtgtttaaatgacttttaaaagtaaaaaaagcattgggaagacttcttactcagaggttgtggtcagtcattttcaaataatttttcattgccaacatctcatacataaacttatataagcttctacaacccctcccagagtcagccttctctcttctttcagtaacatcctgtgttgccatctgactgaactgcaccatttgtcaccagttccaacacatcttgtcaacataccttttctattggaagaaaaaaagaaaatgggcttgaataaaaacatgtaaataaatgatgagcactttgctcttttggttgaattaaacagtgttgaaaggtgttagctagagaagacttaatagaaagtataacattttaaataatgtttaaggggaaaaagaaaaagatattttaggtttcagaataaataaaagataaaaataaataataaaagattttaagtattagggatgacttgcaaaatctcagaggtaaaggtaagaaacactagacagaaaataattttatttgaatttaaaaaatgggagagaatccacagaccctttgagggaactggatcatctttgcagactccctgagatgtcgaaaaactgtgagtctgcttgctttctcaatggggatgctcatggtatggggcaatttctcagccctgatcatctgctgcctggaaatagactcagtgctgttggtaggggatggtgggagtgagaccggcctttaggactgcaggctgcatgggagtggggtgaggcctgtgattgctggctttcccccacttctctggtatcctgtatgactcaacagtggcagccataatccccctgggaatacaacttcattagactgggaaccacatccccatcccccacagcagccacagcaagccctgccaaaagagaggctgaactcagacacacctatccctgcctccacctggtggtctttctctatcagccctggtagctgaagacaaagttcataatctcttgggaggtctatggccctgtccactgcctaagaaaccttaatactcaaccagatgtccctagggcaagtttgcaacctgtctataggaccacagctgatgcactcttgaaaatgacacctcctggctggaggctaaaccaaaaccagtgcattaaacaaaaacacaaccaaggacctcacagagtccacttcactcccctgctacctccaccagagtaggtactagtatgcacagctgcaagacctgaagagggatcgcatcataggactctgcagatattccccagtacaagcccagagcccagtagctccactgggtggctagacccagaagagcaaaaacaatccctacaattcatctctcagaaagccccattcctaggagaagggggagaacaccacatcaagggggcacctcatgggacaaaagaatctgaacagcagttcttgaatcccagatcttccctctgacatagtctacctgaatgagatgggaccagaaaaacaattctggtagtatgacaaaataaggttatttaacaccccccaaaaatcataccagctcaccagcaatggatccaaaccaagatgaaatctgaattgccagaaaaaagaaaaattggaaggttggttattaagctcatcaaggaggcaccagaaaaaggtgaagtccaacttaaagaagttgaaaacgtgatacaggatatgaaaggaaaaatcttcagtgaaataaagagcataaataaaaaacaattgcaacttctggaaatcaaggacacacttagagaaatgcaaaatgcactggaaagtctcagccatagaatcaaacaggcagaagaaagaacttctgagctcgaagacaaggcatttgaattaactcagtccatcaaagacaaagagaaaagaattttaaaaaaatgaacaaaggctccaagaagtttgggactatgttaaatgtcccaacctaagaataactagtgttcccgaggaagaagagaaatctaaaagtttggaaagcatatttgagggaataattgaggaagatatccccggccttgctaaagatctagacattcaaatacaagaagctcaaagaacacctgggaaactcatcgcaaaaagatcattggcttggcacacagtcatcaggttatctaaagtcaagatgaaggaaagaatcttaagagctctgaggcaaaagcgtcaggtaacctatgaagaaatatctatcaggttaacagatttctaagcagaaaccctacaagttagaagagattggggtcctattcttagcctctttaaacaaaacaattattagccaagaattttgtattcagcaaaactaagcttcgtaaatgaaggaaagatacagtgtctaccaggcacacaaatgatgagagaattcaccattaccaagccagcactacaagaactgctgaaaggagctctaaatcctgaaaccaatactcaaaatacaccaaaatagaacctccttaaagcataaatctcacagtacctatataataataacacaatgaaaaaaaaaaacccaacttattcaggcaacaaatagcatgatgaatagagtagtatctcacatctcaatactaacattgaatgtaaatagcctaaatgcacctcttaaaagatacagaatggcagaatgaataagcattcaccaaccaagttttcttctgtttttcaggagactcatctaacacataaggactcacatcaacttaagataaaggggtaaaaaagatattttatgcaaatgggcatcaaaagcaggaatagctattcttatatcagaataaacaaaatttacagcaacagcagtttaaaaagacaaatatgttcattatataatgttaaagggattagtctggcaggaaaataccgcaattctaaatatataagcacctaacactggagcacccaaatttataaaataatcactactagacctaagaaatgagatagacagcaacacaatagtagtgggggacttcagtactcccctgacagcactaaactggtcatcaagacagaaagtcaacaaactctagcctgcaacaaatgaacttaacagatatttatagaacattctacccaacaactgcagagtatacattctactcatcagcacatggaacattgtccaagatagaccatatgataggccacaaaacaagtctgagcaaatttaagaacattgaaattacatcaagtactctctcagactacagtggaataaaattgcaaatcaactcctaaaggcatccccaaaccatacaaatacatgcaaattaaataacttgctcctgaatgatcattgagtcaacaaggaaatcaagatggaaattaaaaaattatttaaactgagtgataatagtgacacagcctatcaaaaccactgagatacagcaaaaaatggtgctaaggggaaagttcatagcattaaatgcttacatcaaaaagtctgaaagagcacaaatagacaatctaaggtcacacttcatggaactagagaaaaaagaacaaaccaaactgaaacccggcagaagaaaagaaataacgaggatcagagcagaactaaatgaaattgaaacaaacaaaaacaatacagaaaataaataaaaagctgtttctttgaaaatgtgaatgaaattgatataccattagtgagattaaccaagaaaagaagagagaacatccaaataatcgtaattagaaatgaaatgggagatactacagccaataccataaaaatacaaaagattattcaaggctactatgaacacctttacacacataaactagaaaacctaggggagatggataaattcctggaaatatacaaccctcctaggttaaaccaggaagatatagaacctctcaacagaccaataacaacctgcaagattgaaatggtaataaaaaaattgccaacaacaaaaaaagtccaggaccagatggattcacagctgaattctatcagacattcaaagaagaattggtaccaatcctactgaaaatcttccaaatgatagagaaagaaggaatactctctaaatcaatctacaaagccagtatcaccctaatgccaaagccagaggacataacaaaaaacgaaaactacagtcagtatccctgatgaacatagatgcaaaaatcctcaataaaatcctagtgaattgaatccaacagtatatcaaaaagataatccaccatgatcaagtaggtttcacactagggatgcagggatggtttaacataggcaagtcaataaatgtgatacaccacttaaacagaattacaaccagaaatcacatgattgtctcaatagacacagaaaaaccatttgacaaaatccaatctccctttgtgactaaaaacctcagcaaaatctgcatagaagggtcataccttaaggtaataaaaaccatctatggcaagcccacagccaactttatactgaagagggaaaagtggaaagcattcccactaagaactggaacaaggatgcccactttcaccacttctattcaacatcgtaccaggaatcttagccagagcaatcagacaagacaaagaaattaagagcatccaaaatggtaaagaagacatcaaattgttgctgtttgcagatgatatgatggtatacctagaaaccctaaagtttccaccaaaaagctcctagaactggtaaatgaattcagcaaagtttcaggatacaaaattaatgtaaaaaattagtagctctgctatacactaacagcaaccaagctgagaatcaaatcaagaactcaacccctttcacaatatcagcaaaaaaataaaatacataggaatatacctaaacaaggatgtgaaagacctctacaaggaaaactacaaaacactgctgaaagaaatcatagacaacacaaacaaatggaaacacatcccatgctcatggatgggtgaattaatattgtgaaaatgaccatactgccaaaagcaatctacatattcaatgcaattcccttcaaaataccatcatcactcttcacataactagacaaaacaatcctaaaattcatatggaacaaaaaaagagcctgcatagacaaagcaagactaagccaaagaacaaatctgaaggcatcacattatctaacatgaaactatattataaggcaatagtcaccaaaacagcatggtactggtataaaaataggtgcatagaccaatggaacagaatagagaacccagaaataaacccaaatacttacagcccactgatattcaccaaagcaaacaaaaacaaagtggggaaaggacaccctattcaacaaatggtgctgagatcattggcaagccacatgtagaggaatgaaactggatcttcatctcttatcctatgcaaaaatcaactcaagatggatcatatacttaaatctaagatgtgaaaccataaagattttagaagataacatcagaaaaacccttctagacattgacttaggcaaagacttaaatgaccaagaacccaaaagtaaatgcaacaaaaacaaagagaaatagatgggaactaatgaaactaaaaagtttctgcacagcaaaaaaaataatcagcagagttaacagacaatccacagagtaggagaaaatcttcacaatctatacatctgacaaaggactaatatccagaatctacaaagaattgaagcaaattagcaagataaagacaaacaatctcatcaaaaagtgggctaaagacatgaatagacaattctcaaaagaagacatacaaatggccaacaagcatatggaaaaatgctcaacatcactaattatcagggaaatacaaatcaaaaccactatgtgataccaccttacttcctcaagaatgaccataataaaaagaaaaaaaaaaaccaacaaaaaatagttgttggcgtggatgcaatgaaaagggaacacttttacactgttggtgggaatggactagtacaaccattatggaaactaaaagtagatctaccatttgatccagcaatcccactactaggtatctacccagaggaagtcattatacaaaaaagatacttgcacatatacctgtatagcagcacaattcactgttgcaaaaatatggaaccagcccaaatgcccatcaatcaaccagtggataaagaagatatgacaaaaatatttatatgtacacacacgccatggaatactacttagccataaaagcaacaaaataatgacatttgtagcaacctggatggaattggagattattattctaattgaagtaactcaggaatggaaaaccaaacgttgtatgttctcactcatatgtgggagctaagctatgaagatccaaaggcataagaatgatacattggacttcggggacttgcagggaaagtttggggactggcgaaggataagagaatattcactgggtacagtgtacactgctctggtgatggctgcaccaaaatttcagaaatcactactaaaaaacttactcatgtaaccaatcaccccctgttccccaaaaacctattgaaataaataaataaataaataaataaattgaatgaatgaaccaaaggtattgcacgaggaagcaacataaataaacttagtgagtgaaacagtgaagaaaggggcaatgtgatggtggtgataggtatacaggttaccttgttcacccttttaatactgtggataaacagaatcaagtaatttgttcagctaactagattccatgaaaatatgtagccatttttctggctaaatgtaagaagagggaatgaacaattgggttagaaccttcataaaaagacatccacagggaagctacaaagatttcttatggtccccaacaacaagttcgcatactgtgcctaccttgtttttctcacagtttgatttcaatcctctcacattttgtgaggtggctgtttataccaatctgtggcctaagatattcttatgactattacttgtttatcaaaatggtacacattcttcagttgcagctccacaggctttctggaactactgtaattaacattgatttctttatctctttccttatttgtcatgtatgattagcactacatagaatgacatttactttttctcctttttcttttatatgtgctaattctgtctctttagcctagtcagaagctctgagttcgcagaataaccatgaacacagaattaaaggtctagatagatcttgtctaaccctttcattttcaaagaaggaaagtttgtaaaatggaaactacagtgatattgagtgtatactatgtgtcagacagctttaacatttttgtatgaatcactcgtgttgtcatctcaaaggtcatatggaatacatactattattgtcatcattttacaaatgaaaagaacgatatgcagagaagtggcttgctgagggcacacagctagtaagagacagtgctgggattcaactctagaccttctggctctagctcttaactttccaagttagtgctgcaggtagaacaaaaactctgtctcataacttctttctccatttcagggctcttgcttgttctaactaatttgtaccaccataattcttatactagagcataataaaacaaaagagatgcaagtgtttattaacttcagccttgtatttcacagatcctaaacatgtaaacatacacctgatacactctcatcctttccgaagagagcaagtaataatgttatactgagtgattaatgaactgatgtaaggactcagtaatccgcatgcaattagtggatcaacaaagcaatttacgcagtaggtatgtattttgaatagtattctttctgtagggaaccagctgtatgtagtgtttaattgaatgcttttgcatcacagagtgatttggagtcaaatcatcaaccgcatttcccaatgtgtcaagtagacagttaacttatcaaaacttccgtagtactcagttctcttccaatgtgctccttatcttgaattcttttgaaatagtgtgccttataattttccaggaatgatttacatgtattcctgttcagagacagagggatggattacataacattccctgaggccctttttgccttcgagtaaatgctctttatcattctaagcttcttactctgagtaatatttgaacatgaccctgtggattccccataacaatttctgatactgtttccctagttgatatgtttggatattttccatactatgcaggctgaattctctttttaacttagtatgttctttttcactctgatgctttgacttttgccatcatagttttctttattttcagagtttatcgactgtcactaggctttcttctgagtcctttcgccaagtcatccatactttgctcttctaatcttctgttataacaggcttcctgttacttatatttttgctgttatactctgaatttgttccagattttctggtagagatttccctacaccaaaaacagtattccaggtgcagccacttgagaattgagtagagataaatatgtgcgcccctttttactgtgatgtcttgccatctgcagttcggagcctgtaaaagttagatttgggattgaaaataagacttccactaggactgccatttgcagcacaaactcacctggatggtaactgctgtctagccgcagctccctttcgacaggtccttctcagaagacttcttttccaggcttttttcttcctgtgcatatctgtgttttcattcattttcccctggtgaataagctggccctttcccaacctgactctcatcttgttatttgatcccaagatctgtaactcctctcagaccatctgcattatttctctgtccttgctgatgttttgcaacattctccagctgactatcatctgcagatttcattagcacaccatttactatgttctgaagatcattaataaagatgaataaacagaagagaagaccttctgcagacatctgtggaatttctctgggctgcccccacaactcgatcgccattgttttattttacctttttggttttttgcctagtgtttcattcacttccctccataagcaccctgttgtcatatctgagtaactgcactcataatgtgtgattttcttgcacagctttataattgcctaaacaattcatcatttgtctgacagcatttttcctttattaaatcccagttttattgacagttttcattatcttctagattgcagaagctatatgtaacaatgtgtgtgcccattctgatttctcctcaatttattactgttttaaaacctgtactatagatgataggaagagagtacgatgagaagagatagactcagaatctctatggctcttcttggaaaaacaccataatgtgtatggaagatcatgcatggggattttcctgcaaggcgctaacagtgaactttctatccaaaaagatagaaagaagttgtctctggttttgaacaatgaagatttatatctaacttatattgaaaaatcaaaggattagattttttaaactgaataagaaccatagctgtacttagagaatatctgtgatgcacttggcactgtgataagatgtgatgtatatcactctttatgattacaccaaccctgaatggcacttattttcaggtgtgacactagcctatggcggctgtcatgaggattagaaaatggtgtcccctccaggaggatactgcctgtgcctgagaatagagcacaggctgcatctaaggacccactgaccttctaggccagatatctttgtgtgtggcagagcctgcctaaatgtacatggaagccacgatttctttgtcatttaaatgaagaggataagatacctataaaagatagatttgagattgatactaatgtggttcctccatgccatattgtttctctgcacatagaacaaatatggatctaactcatacttctgtgattgcctactaaattcaaacagtactttgtgtttttacttagaaaagaatggatatggccgggcgcggtggctcacgcctgtaatcccagccctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagtgagactccgtctcaaaaaaaaaaaaaaaaaaaaaaaaaagaatggatataatttaatatgtaaccttctcttccaatctttagctatgctgttgattttcttcccagtcttcagctatgttgtttttgttattgtcattattattattattatttattactgaatctagaaagaatcatggagaagaagcagtattactctgggccaggtattctttgtaatatctttaaaatacatttgaactctgttcacatatccctttgtttgcctattagatccggtcaacattatgcaaacacacaccttcatgatattgaatattgatcaatttagtcacatgccatgcaaacgtagaaataccacttaatggctgggcatggtggctcatgcctgtaatcccagcattttaggaggccaaggcaggtggatcgtctgagctcaagagttcaagaccacccagggcaacatggtgaaaccccgtctctagtaaaaatacaaaaaaattaactgggtgtggtggtgcattcctgtagtcccagctacttgggatgctgaggcaggagaatcacttgagcccaagaggcaaagttgcagtgagccaagatcatgccactgcgctccagcttgggctacagagtgagactccatctcaaaaaaaaaaaaaaaaaaaaaaaaaaaactactacttatcaaggaatgttttgaatgctttaattctttgacttaaattactatatatatttataaaggtgtagaagatttaacaactggaatgtgtgtgtgcgcatgcacatatacacacatatgcacatatgtatatatgtgtatgtataacatatatatctataaataaaagttatttaccaaagcatcatatattttcattttcttttctttccttttgttagcattttcatttttcttgagtactgtttttattgaaatgcaccttgcactttagctatagagcttttccttgttgaacaatgtagttttcttgctcaacaactctgacatccaggtaaatggaaggaaaatggataggggagttgtgtgttcataatgccactttgccaccctgaaatctatgcagataatctacttggaaggctttgagccccagtggaatacagaaccatgtaagtatcctgcattgatttacagcacctgctacagctgcttggatcttggcaggcattttctctcctgccaaatgctgttgaaattgctgggctggtttagatggaggttatatttactggacatgtttataatcttcagagtgatctaagccatagagagctaatttcccaaagatcaatgactaagggaggatttcagaggttatcctctttatccgatttcctgtgtcctaatgagatggctgaaacctgtttggaatctttctgattaggaactcttgtgagagtcaataaagaatatgacattcataaatctaaataagaggcgacttggcagcctgtaggtgattcatgccacgagaagcctttcccctgcccccaacaggatgtgccatgggtggccaacctgagacaaggtcagacttgaaccaagagtcttgagaggacttggcctctcctggttaattcagaggactcttctggctattagaatgcgctgtgtatattttttacctgtcttgatttaattcaattcaattgccattcaattcaaacgaaatgtatttgttaaatgattattatgttttccaattaagaaggatgacacaaaaaaactatattggtatatggtaaggatcattatatagatctaaaaaagttttatcaaagatgatgataatcataatagctaatgtattttgagtagttactgtgtcaggcagtgtgctaagcacttcacacatgttatttaatcctaacaaattcatgaattaggtcttattatacctattttgcagatgaagaaactgtgacttagatgcattaattaactttccatgttaacaaaatccttcccaaatcccatattcccctctcgctgtcttttgccccctctcagctaatcttctaggaaaaacttgtctgcctttatcatctctacttctttacctcccatttgtttctcaacccattcagttaggcttctgccactgccatcaaaatgaaaattaaacagggtcatcaattcctccacatgtccaatacagtatttttgtttcactggattgctcaccaccttttcccacaattaaccacttccttctggaaacagtatcttctcttggtttcttgtaccacatattcctgtgtttcctctggaatcatgagctgcttatctccatttgatagcacctcttcctctgcctaatttctcattactggagcattttagtttcggttctgggtcatcttctcttgcccctggattctgccctgtgtaggggattttaaacattgttggtaccacgtacattattggcagtctcatgaagcctatagactcgaagtgcataaaataccctggatatctctcagtatcccaaacgtagttcttacaaatgggaactcttgttttccatctgcaaatttgtttttcctccagtcttgtccatcatcaatccagttgctcaagaaaactagaagtcatctatgattcctcatttatcctaaaacacaaagcttataccatccattagcatgtcttggctattttatcttcccaccgttccagattttcccactttttccttctatccactgccaccctgctgtcaccccttaggtggtgcttaatacatgtttagtgtatgaagaaaggtttggaatggggaaaataaagagacacactgaatcactaggggacatgtaatactctaggcaagacccaagatagaacagggacagtctgaactgaagacaagaaggatgaatttaaaagataagtgtgtccagtggaaaatacagacaaagaattaagagttacaaatgcctgttagtgtaatcgggttgtttgaagctatcttttaaaaatttccatttctttttaagtagccttttacctcatgttctgtgaagtcttttggagacagtaaatcatattgtttgggaaatttaagggtggagatgggaataaaactgaaaagaggaatctttcctagattaagttgacaaagaaacagctttcttcagccatttctctccagacactagtcaaacaaacaggtgagcaccagatagtttgagcagcagctggaacagttcaataagagtctccctctagcctctccttacttctgaataagccaagttaagctacagtcaactagtcggcttctctaatattctgtattgttctgaggtttaaggctttgtttttttcttggctgtctaggctctctgattaactgagattaatctctatcatcctgtgtaagctaaaccctaaattacataatatgttttctatctgtatgccatatgccttccatgtcagggatgactccagagacaacaaaagcaagctgtgtttttactgattttgcaaacttgcattcatcagccttgggcattttggcctccccagtgtcagtatggtgttttaatagctgagaaaaacaacagaaatataaagagaggacactgtgaaaatcactttccaaactgacttgtattgaaactgcctcacatctaagtaatggaaaataacagtgattaggataatgcggtgcattacattcggtgacagttaatcctcttattaacttcatggtcatatttcgctcatttgttaggttggaaggactgtgtgagaatattgtagttcctgtttttctgttcattgggaaagttgggaaaatagttctaaaaataaaagagttccaggttgaaaagcctttgaggttgactgttctctctggagatgcatgtttaccttgtgccctttatccatgctttgagtttgggtacccactctttgaggcctcattctcttccctttagaggattttctttccacctgagcaatcaccagtgagggaaaagtcagtggggtggttcagctgcatgatatgttgcattgacaaatggaggcagagccctgctccagccccgtgagttggaacaacctacaaagcatttctggcagtgagccaaagaggtgatccctcctctagggaaaaaaaaagtcaatggctgagattgcagttctccatccccttgctgggctgattcatacagcagcattgacactgaggtctcagaagaactgttctcttcccagtccatctaaaaatatctaaattcagatttataatgtcaggagctgataaatttgctgaggaaatgcaagcagtgtcactgccatgctaggaaatctattctgatgaattgatgagggaaagaaattccaaacatagcagagtctcagagtgccacttcccctgggatggtgagcaaaatgagcatgttttccttgccatcgaagttcccttcttcaaacatagtagaaagtagaatatactagattgaaaaggaatatggaaaatacctttttgatcaaaagcatgacatgacataaaactaaatcttatggcctgtaaaatattcttggtttacgtcaagcaaggggttcccttttaaaatgctctttcactaagacaaaaattccactcacatagccctggtgacttttgattgaatcaggatcttttaaatttggaactcagcaagaaaccgactgtcttactttcctacagcttttgtttgaactttcagaatctaagttgatattgcggtctgctgctaaccagctctttcctctctttagttggtcagtggattctcaggagtattataggatgtttcctccataccacctggcttgaaatgatttggcataggcttcaactctaatttattcagcatccctttagcgcctactagaaaccaagtatcatgactggaacttttctgaaatgatgaaggtgccatggggacagatgggcgtgtaaagaacttattacaaatcaaatcataacataataattgatactgaacaattgctatgagaattgaacagaggaaatgcttctgctgggaaaagaccaagaaggcttcagagaagaagcaaaatttgtggttggggtgatacaatgaatgagtactagcaatttctcaggggagcagagtatgtctaacaggcagaacagcatggcactaagttaggaaaagtaccacctgccttagggacttcaacaagatatttgaagtgtttaaataatttttttttctcacttggattttggcttttgccaaacaactaacaaacaactgttacatttgatctaattattttagatcattaactttgaaaattgctgtttgtgtgatttcctacattggccttgggcctattatgagctgacatctaatgaacaggtggctggtacattcctggagttttgcccttgtcaaacacttgacccagaccgcaaaatgtcatggtagctttccctgctgaaaccttgtggacttacagctcagtaacgatgttctaatgatctaacatgctatgccatcatttgttgattcataaagtcatgagataaacactaacattattatcactgtctctttgaatgaaaattaaaggctagacttttaattttatgcagtattttcctgactcaattatttgcattaaaaaatgtttaggcatttcattctcatggacctacctcttaatatgctttcttcttaatcaggcaataatttgtaggtttgggcctcaatttcaatagcaagtgagccccaaactcagtaaaaagcaaaaagggttttttttttctgagattcaataggaaacacagcatacaaatatttcatgtaattttaaaaggtaatttagcatagatatgcatactgaagtatttaggggaagtagaaagatgtctgcaatttattttgaaatgcgtcaacaaatatgacggatggatagagggatagataaatgggtggatatgtttgaaagcaaatataataaaaatgttaccatctgagtataaaatacagctattgattataaaattattttaactttgtggaatgtttgaaatttttacaatatgtttggggagaatgataaggtagcaaagaattaaactggtagaggtgcttggataagaatgataagatacttaaagtgaagagaaatttctctgacttatcaaaatgtagacacgaatgtagttgtgtctgtgagtcaaagtacacaatctctcttctccattagcttatgaatctgtcagatgagaaaaaagatcatcctaggagaaagagtagttcactgtaaaggccagaactttagtctacttggcaatatataaatagacttttggggtttatttttaatataaaacactgatatttttcgcaaataaggccatttctgccttctcagtcatttcaacatatattgagcacttcctatattcctggcatggtgctaagcacgggggctttaacttcaaaaagttgaacatcaagaatggagaaagagaacaagaaggtgatgtcgcacacggaaagaaggacttaaaatgtgctgtgagagctctgaagagggagaagtccctggcttgttagctctgatttggggcaggctactaaacctttttgtgccttagtattttcctctataaaatctggccaataataaatgttaaactactgtctgttaaatagctggaccttcataaatggtcactaatatctttaacccagagaggaagatcaaattaggaaaaaaaaataacacagccataaaatttgtttgacagacatccttctttttcccatccctcctctataccccatcttttgttgccctagtagaatgataaaatcacagccctggagctggaacagacctagccctagattttggacagatattccattccaacccccatttagaggtgaagacactgaaataacttgagaaaagtgacttgtctcaggtcccatagctagtcaatggcaaagtgggtgaacatgtaggataataaagcttttactggagagagaggttgaagaaaagttctttggaaatatagtttatgatttcttaggatgtaagagagaaaatgctcagaaactttttttattgttagaagagaatgtgttttagtgtacctaaacacattgcattagtaggttctcaagaggcatttgttgacttgtattgcattaaacctctcctgctaattgtctgtatagcatggttaacccttgttatgtgggtaactgttcctttaattaaattagtttttaagtcttttaattatattttggtgcctgtaattgacagaatctatatctcttaaccccacatagatttatgcagttaggggtagtgaagattgcttctctctttgtgaaaatggaatgagtactcttgtaacatctctatatttgtatcttatttgatctgtgggacatagaacattttcttgacaagatagcgatttcccctagagatctgtcaattcacaactttgaattaaggtctctaggcgttctaattatcagagccaatgacccccgctggctttgacctccaatactttagctggacagttcactcagagcaaagatagaggttctttatactaaaggagaatatttcttatcacagaggagggaaagaaggagaataagagaaatagagggagtggaggggatgagagaagggaaagagaaagagagtaagtgagatgtcactgcaaaatgtttttaaattatttagttgatactattaggttggtgtaaaaatagttgtgcttttttccattaaatagtaatggcattattaaaattggcattattaaaagtaatggcaaaacggcaattacttttgcaccaacctaatattaaatttttaaaaaataaaagtcatataagagactaagcaaatccacaataaaataaataagttgaaaattagtgaatgaaataggatctccacaaacaatgctgcagaatagtttagaaacactgaaagatatttctaacatgcaatacagatcctttcatgcttcatttgagaagctggtataaatagaaaagtgaatgtacagtttcagaatctcagaccagaaaacattctagagcacaagttctaagacaaaagaaagagaggactcacactctacttgggaatgggctgatttttgctccattgagcagattgcactgttgatcaacaaggtagatctggtaagaagttgagacagagacaccacatgctgaagaatctaggctgtcggtgctttttggaatctcagaaagaggtcagggagcccttgtgactccaggaggtaaatgactttcccattgtttgctgttccttcccagcctcaaaaagtagggatgcagacagctgcttctgagggtgattttttttaaatttaaaagttccacctgggcatgatgcagttgctcatggctgtaatcccagcactttgggaggctgaagcacatggatccttgagcccaggagttcgagaccatcctgggcaacatagtgagaccctgtccctacttcaaaaaaaagaaaaaatcagcctggcatggtagtgtctgcctgtagtcccagctaccagggaggctgaggtgtaaggaccactttaatctgggagatcaaggctgcagtgagccatgatcatagcactccactccatcccaggttacagagtgagaacctgtctcaaaaaaaaaaaaacaaaaaaacaaaaaaacaaaaaacaaaccttggaaaagtctatagcttcatcttatgcattattcccccatatactgataaaattcaagtcccttcatagaacccaaacagctgataatgtggcccataattgtgaattccccaagcccagcatttgaaaagacaatttaaaaaatgagagagaaagagagtcagtgctgataagtatgaggtaatgtgaatgtgtaggcacagggtgactttgtaagtgggaagaaaaggagggagaagctaactttcattaagagtcttctaggttgggtgcggtaaatcacagcactttgggaggctgaggtgggcagatcacaaggtcaggagatcgagaccatcccggctaacatggtgaaaccccatctctactaaaaaaatacaaaaaaattagccaggcattgtggcgggtgcccccctgtagtcccagctactcgagaagctgaggcacgggaatggtgtgaacccaggaggcggagcttgcagtgagccgagatcgtgccactgcactccagtctgggcgataaagcgagactccgtctcaaaaaaaaaaagtattctgtgagccaagcgctctacttgattacttgatttaatcctcgcaaatatttttcatataacatgatgagaagatgggggttcttgtaagcagcagaactgggatttgaacccaaatctctatgacataggtccccatacattttctatgacattggttgtgtgccatctggctcatgactttccagcaatttcatggataaaagatgtataataatctgacattcaaaacccatatacttttgcctgtgttagctgctctgggtaaaactattggataaatgaggtttggagaatagatgtgaattttcattattcattcccttctgagaattgtccaaataatattatttctaccagggtgaaatagagggggaaaaaaaacccctaggtttctggaaatattgactatgggatataaggcaaatttagatgttaaaagtgatagttgccaaatttgtcaaatgccgtaatgttctcatgtacaaaaaaagttggggaatttttgtcagaaaattatgagttttgcactggccaattcaaatcaaagagtttttttttttttcttgtctttggcaggttttacaagggggtgtccctgaggggaggtgaaatgagacctagaagcaatttttactgtaacacacacatacccatgcactaacttgctttcatatagttacctgtacatgccacatttcatgattaaaatgcagtccagaaaaatatggtgcactgggctatgtatgagtcccattctctttctttctatttttaagtggattttatgttgcctatttagtctgtaatgaccataagccactccagccaacttgttttaaagctcagagagaagtaggtcactaaacaatagaataataatgtggccacatatttaactttctagtacccacatttccaaaaagtaatttcatccaaaactatcatttcaacatgtcattaatgtaaaacactgttaatgagatattttgaattttttagtggtaggtcttcaaaatctggtgtaaatttgcactgacagcccatcacaattcagtcaagcccacatttcaagtgctcagtaaacacatttgtctagtggctcctgtattggatgacacaggtgtagactaggaaagcattcactcatggtgtttattcaatattttctctatcttctatcatttcttatattaagttgtagagagagagcgcactatttctaccccatcagagaacatgaagggatgcagagaagaatatgttgagttgactacctacctcacagaggacctctgcatgacatttagttgaagggaactgccttctctttttccaggaagattaaatctgtatcctctctgccattcagtttaatacctatgtgcaaggcatcagtagagaccagatagatagatagatagatagatagatagatagatagacagacagatagataggcagagatgtttgtgtgtgtgtttgtgtgtgtgttgtgtgtttgtatctctaagtacatgaagaattggcatacatcccagaacacaacagactgaaactcctgattaaagataacaggtaaatggaatgaacatccaataaaaacctgtttgtgtttttaaacaaaattaaaagactaaaataagaatagaatataggaataggaagaaagccttacatgacaataatcaatttgggtaccattttgttacctcctggccttctgcaacttaaagggaaaaaaaaattaccaccatcaggcaaatgccttatcatgataggacaaaattcttcccattgtgtggctctgttggcatttttaaatgtgtcatatgtggctgggttgtggggtacaagatgtagacttgcttaggagacaaagaccagcataaacttttgaggatccatcctacatggagaatgtagtgaatatgctattgctctaagtggagacagagtcttgcatggcaggaagcttcctaaggtgaccacttgagtcatgaggcttagaagtctttgcagaagagggaaatgagccttcacattaggaaaatatgctttactattacataagttctgggatcaactgatacaaaagttgggagaaatcaaaattttaagtttttcctatgtgtgtacctatgatacaatcaagtttttattcaatttataactcctgaattcattcatcaggagtcctttaggaagctaaacagaactggcaggtctgtcatttggatttgtcatgattgtgagtatttcgttccctgcaattaaaaacgtctgtgggacaacaggatttcaagtcaggagattgttgggtccttgcttctgctacttagctaatctgtgactttggaaatcactctctgaatgtcattttgtttacatctattaaatgtaagctctctctgatagcattatgatgaggaaaaaatgaaagcatgtgtctgaagtatctggtacagaggccagcacatactggttgctcaataaataccagtttctttcccttttactactctaacaatttctcgtttgtattttctgctcctgagctctgtgtcttgaaaagttctgttggcatacacattggacttgattgcttacattaaaattatctattcttgtctctattttgtattaatgaatacaattaatctgattacaagtataaaactatcagtcaggtttctaaaaagttattaaaacatatatgtattacctgcttcccacattccagtgccaggctctgtagaaacaataatgaataatacagctattgccctaaagaggcttcaccaatcctgtctgtggttcagcatcaccaggcaataccaatttgtcatcatcatgctgaatggggagaggtttagaataatcacaggagaacgtaagaccagctcctggccccgtcttgatgggtcatgaaagaacaccgggtactatcctgagttgaaataattctagctcatagttaatctataaagccttatccagagaaattggagattatctttaagcattttgaaatattaagcatagcctgctggccccaaatgacattttttttaatatttacaaattattaataaaactaaaaatttccatcccttccctggaaccccaagcaaccaccgattatttatttatttattatttatttatttatttatttatttatttatttatttatttattatagagatggagtctcactatgctgcccaggccggtcttgaagtcctggccccaagtgatccctccgcctcagcctcccaaaatgctgaggccacaggcacggatgcagagtttgcagatgggcagctaccattttcgagtatgcagtaactgagttttgtgagaagagcaaagtggaaagggagaatgacttaattaggtctgtcctttagaaacaggtctgcaaaggcagtgttgcaaactaatccaagtgaaaaatcatgggagacttaaatgaaagcattcctgggaatgaagaaggcagatttagtaggattactaatgacaggttggatggaagatacaaaagagaagaaatctatattgctgtgatccattaagtctcattgtctacttttaacacttaatggggtggcagtgttgttattctaggctatcctttatgaggttggggttcttccctgacagttgctgaggctgtgggaacaaacgagttcatatagggagtgagtgaggagggagacttcagacgctcagggattctacaccatggaggaggctatgaaggagatccattttcttctaaatcattctgataggcttctggatggctttcggtctctggccaggtgctgatggaaagctctcctctctgatgaagattaatcatcaaacccaggagataattttattctgctcttctgagtcatgttagattccagaacaattaactttattttccccaaatcttgtatctcttgggaatcttccagtaactttggtttccagtctacggagctacttttggcagcttgttgtcaaagaagtgataattcttaaagcttagagtgctaaactgcaactcagttgagaattgaaacctttccagtaaggggctcagccccagacacctgggactcctctttctcctttcaccctcaggtacaggagtgttacataaaatggcactaatccacttttacagtttttgtgttattaagcaatacattaagatttaataaccataacaaaagggttgttttctcaccaagcagttattatttgttgtacttctatttctactcatttaccttaggtttgctttagcgatttcaatttagtaggtgtctaatgatatgcctgtcaatgaaactttagagatgactttcagtccttggaatttttttttcatagtttcaagaagcaagacttgcgaagatgatttgcgttaagaggtttgtgtgagttgagtgtggacttaaattaaaagtaacttaatttactcagagtagtagaatctagtgcatttaaattggttgagaggtgcagacttcgctttggaagtcactgtaaatcgatgccgatagagtaaaaagcattctctgttctcttgctgttcctttttgaagggttcagaaggttggaagagcatccaaatcagtataatcagacctattagatcctagcaaagaattttaaatacatacatctttttgcatattgattctggcaatttaaccctcagcttaaaagcagaaagttggttcaagtgaatacaacatctcactctgcacaatattaagaaatagatctactgaaactaataaaagaattccattgttgtctcctccatttaaaaaaattctacctgaaatacttgttagaatttttataaaagtagtatctcatttatgtacaaaatagtttgtgtaaactataagtagacaaagatgtagggttgtatcacttctttgataagatactgatcttgtatttttaaccaatgctaggcttaataaaagggtcctgtaaaatttactatgaaatctgtatgcctccctccaacttcttttccaactgagattggagtatggcaaaggaaatgaagcatgaagggaaaactaggagctatgataatctaagattcataaacaattataacattatttgctcacttttgattgtgcaaatgactaaatcttttaatgaagcataatgacccatctgacacatatataacaacacataataaaagataaaattaaatttgtcaaagcaatatagaccacccactactagtagattatgtttgggtttggattttcatatattttatccatatctgtttccttctattgggactttatggaggcattactcatgaactttggcagatcttttttggtgtgtctgaaagaaaatcccaaagctggttactaagatgtttgaaagtcatattcttcttcaaaccgtgtagaaataactatcaggaaataagtggttataattttaaaatggcatgtttagggaagagaatatataagtttgaaaaaccgcagtctcctccaatacatttctacctattactaacagggtcaaaattgtctacagaaaacaacctgatctcaatttcctcagacaattcagctagtaaaatggtgtgactgacctagagttacggagataactcctactgctgagctctctcaacaagtgacaccctggttgacaaacaatcacacattatttattaaacttctatttaataacaggagttatggagttagcaatgttaagtgaagagtccttgttttcaaactttgcaaattacagttagtaactaataaactaattaatgtcctttatgaagagatgctcagtgatggcctgaaaaatccctaaaggagatagggagagaattgaagtatggaataaaatgacctatatgggaccttcaaacttggagttttctatattttcaaaaattacttttgctgtcatttaatgtccaaatccaatcccttgtctagggaaccagttcggattaaacaaaatttcaaaaatacacaagcaatcaatatctaattcatttaagtcctgtttcttcccaggactgctgggtataagcctagagttgcctgccatttctcttatattcaaacactttgggaaaggagccatttttttagatctattttctccctgaagcttgggagctatatctatataaaatgagatgacatactagggctagcgtactaaaaccttttctaagagaatcaatatagctttgagaagcctcatttatatttaaaggagaaaagagacataagtagaagtggacataacgtatcatgtagacattgaaaaataccagaaatgatttaaaagtgactgcgtgttctcatattcccagtgccttgtaatttgacttggagggatgttctagatctccattgaatgtgctcactgagatttgtctttgtcgtattgattacaatcatctgtcaatgccctcaatattttctgtactgaccaacagcgacacagatcataggctgtaactagtacaggctgtgccaatgaaacaatagggctaattagcagacatgaaaatgaatcactgatttaattttcctcctggtctaatcaacacaatgtgtcagctaaatattttgatccattatttcaagtgaatagaatgtgcttttatattatcatttcaatttcattaccttgaatattggaatttttgatttttggatacatcagtgtccagtcagtatccagtgatttttagatacattttggatacatcagccttagcatacatcagtgcctacgggtataaggcactgatatgttaataaacatattaacagtttgtaagccaatgaaacctataattattgcataatttaaattaacttgtgtacaaaatgccataatatttccacatacgtggtggctttcaaaatcaaaataaggtgagcctatttcaatttatgacagacaattgtatatctcctctcttttctttgccaaagaagccctttatttcatcctcacaggtgttatacttgtctcctttctgcttggtgaaacaatcacggtttgtaatttcactttctgaccatcaaatacgataaaatgaaacagtttgtgcttttcttgtactttccgctctcaggggttactggttgagagagctcagcagtaggagttatctccgtaactctaggtcagtcatgccattttaataggtgaattgtctgaggaaattgagatcaggctgttttctgtaggcaagtttgatcctgttggtaacaggtagaaaatgtattggaggagactgaggtttttcaaacctacatattctcttccctaaacatgccactggctggctgggatgctaccttataaatgtgaggtagatgacaccagtctgtaactctagacttctgtcatggatagcaggataacttagactgagagctgtctgtcttcccagcccacatggccacaggatcagagcaggtcatggtgaagcagaggagaaacagctgcaaagcagagaagaaagtccaatagggtaggatgtgatgaataatgttgtgaaacagacagctagtgccagtaaggctcctatatcatagaagtctaggaagatacaagcaagtgctgtcatagacagataaatgaagtggacattgttttgagacaaaagcaagctggcaatatcagagaagcttactataaagagcaaaatgctgggtgcactggctcatgcctgtaattccagcagtttgggaggccaaggcaggaagattacttgagctcaggagttctagaccagcctggtgagacctttatctctacaaaaataaaattaaaaactacctgggcatgatggtgcaggcctgtagtcccagctacttgggaggctgaggcaggaggatcgattgagcctgggaggtctaggctgcagtgagccatgacagcaccactgagccttggtgacagagcaagaccctgtatcaaaaacaataacaaaacacagcaaggaccctattactctcaatgggaaaaatcgcagttgcttttgggccagcctaataataacttgacagagagaattttattccctgcaagctacgagttcgttttctttaacagatgaggtaactgagccacataaaaattaagttacttgtctagagacacccagctgataagtaagagagcagacatttctactcaagcaatctgactccaaagctcatggtgatgaagcaggtcatgaaagctctctttatgacacatttgaataaagcagcatgacagtgggacaaaaagtacacaagacaaaagctccatcgttagggccaaagcataggaacaaactcaggccagtgatggagcaacttcagctgagattttagccaagagcttgttaacatctttccagttcccagatagaattagtcctaaggaattacgaacattgtattccatggcatatatatatatactacattttctttatcctctaatcaactggtgatggacactgaggttggtttcatatacaagagcagatgtcttttatttttttttttttgagacagagtctcactctgtcacccaggctgaagtgcagtggtgtgatctcagctcacggcaatgtctgcctcctaggttcaagcgattctcctgcctcagcttcctgaatagctgggattacaggtgcacaccaccatacccaggtaatttttgtattttcagtagagatggagtttcaccatgttggccaggctggtcttgaattcccaacctcatgtgatccacccgccttggcctctcaaagtgctgggattacaggtgtgagccactgcacccagccagatgtcttttttaatatgatgatttattttcttttggataaatacccagtagtggtattgctaggtcaatggtagctctatttttagttccttgagatatcttcatactgttttctatacgggttgaaccaatccatattcccaacagtgtataaatgttctcttttctccacatcaacatctgttgttttttgactttttaataatagctattctgactggtataagaggtatctcatgtggctttaaattgcatttccatgaaaaagaatgaaatcacgtcctttgcagcaacatggatggagctgggaaccattatcctatgtgaaataattaagaagcagaaaatcaaatatctcatgtattcatttataagtgggagctaaacaatgagcacatatgcacataaagatggaaataatagatactggagacaacaaaaatggggagagagagaaagctgaggattgaaagatgatctattggataaaatcttaattatttgagtgtatacggagagcccaatcttcaccattacacaatacacccatgtaacaaacatgcacatgtactccctgaaactaaaaaaaaaagaaacaagcattgtgaactgctggatccccaagaaaggcagatgaccataactaggaagaaaaggagaaaaaatgtgcaatgtcaagaaacatttttgtaacttatggtcaatcttgtgtttctgcaacacctatatcttaccatgtagaaatttagggatacaaaccacaaagattctgagggcctaatcatctctcctagacttgcttttgcattctggagtaataatctggaaaagcaataagagtagggacatatttatgattattcttaaaactgtgtgtagaaaaatacaagaatatctactccaaaaacctgcatgaagacatttgatagttagccaaaattcaagagactcctaatctttgaaagctacacattaggctggtgtatatgtcccattatttgaaattgcacctttaaatatttgagacatttatcctattatccctgattacaatttccccactacaattcactgcacagtgcttccttagggagctgcttaatacatttcaatcttagaaggtcaagattccctcagccaattccaaactgcattgtcccattgaatagatgtggcacattctggatctagtgagaataacctatgtatattactttgaagtaatacaggtaggccattatagcagaaagaagttgagtaaatgttgatatttaagaaggttgataaaatatttgaacacaactgcaatccatacccaattctcagtggttttttttatagaccatgaaatcatagctaaagtcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatcttttttattctttcttggaggcatggaaagcaactcaaaagaaaaggagacctctatagtacatccgcactcagccttggatagtgagaagtactcaggtctgagtagcctcagacagtggagtcagaagcaagatgaactgtcagggattataataggaatggtcagggctgaaagcaaggcaataggtcaaaacctggcaacaaggaaagagccctggataagtagtttccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgatactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcagcttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaataagtatgcatgcaaaaataagtatgcatgaaacataagttttcaaatatcatacactgacattgattaatcatcactagctgtcaggagagagtgctgtattgagaaggatttagcaacccagaatgtcctaactggcttggctcatgtctgctgtgggtaaaggaaaagcagggagtgctgacaagtctgctttgtatttgccaccctttgcaaataggtactcaccctattcccaaagagctaatataaattacatatcactttatttgtgtttgatttattacataattattattagaataattcacataattataaccagaagccccaaaagagcagagaccctgactgatttgttccatggatacctccagcatctagaacaggacatgacatatagtaccccttcaaccagtagttgcctgacttttctgccctcatttaatggatcctgtctctgaacctgcaggcatcatcatatactatcgtaagtgatttccttagcttcctaaacccagaaagaatccacattctatttctcatggtttttttctatctgtatagcagcatcaaagtgggccctggtttttagtttgagggatatgccacttctgcaaccagctggcataaatgtggcaattgacacgataagagaagctgttctcccagccagggaagaggcattaccaattacaggcctatactataactgtgcctttaacatcacttgcatgtaagaatgcaggtctctatgttagaagagtgatatctgctcacagcatctcatctcctcctcagctctcccagcatttgagcgctctctccgcttcgttttcaaccatggtagtctaatcactggcaaaccaccagtgagttgattgcagccctttataattcctgtgtagtgagatgccataatgacttttccaggagtttccacatcatctgtttactccatgtgacattccttccatctgtctactttcagtttattttactttattttttagtaacttcatatcgcagatgaaagtactgtgaagtttcttctcaaaaccataatatttttgttacgttgcatgataacctcaggaaacatgaaattctaagaatttaatactaatatcattttgggatcattttttaaagcagtaaaagactttatgttcatgttgtctcacttttcagaggaattcatagctttttattgatgtaagccatttcataaccctgtcaaggtgctttgaggaagaagttaactgattgaacatcaacaaatcctggaatgtttgatactaatgatctcagaaggggccctgcctgatctacattccacctgagcactccttaccaaatattgctcttgccttcctctgcagtgattggttctgatcactgtagagaaagcatggaagctcattttacaaggctgcatgtgtgtctggctgctacctagatgcatgtccttcttgcacaggtcaatccattctctggtttttctctcctttgctctactcccttacacagaaacctaatttacctgtttctttcttaagctcttcatttcagaaaaactcaataaggaaaattaaaaaacccctcctttaggatgtctctcttatttctgccagctttttgaagtatgtgtgctctgggcaggggtggggacaggaagtgtatgtgacaaagatcagtcagacaaaacactcctggcatgatttccattttagagttgtgaaactgaagaatgggcaggtaaactgatattttctataagttgtgagaccatgattcactgatttgtttaccttaatgaagcatacgtaaaataattgataaattattttatcaataatttggtaatttcctcttggggctaattgaatatagtgagtataattgagtatacggtgggtggctttcaagcgtatctttccaactttcactattttagtaccctggctagaaaatgataatctgatagtgaaaatattaattcatcctctacaaggttctgaagatactaacttctcagtaaattcagatatagattacaaccattttcaggatataataaagaaggactaaaggtatctctttggtatgtggttctttacggccacataaatggcttccaagtcttcatttccttaagttcatttcctgctaccctatggacattgctaccctctccttctctgggttacaaataaatggttgatggcattttaataacaaagattaaccaggttgccatgttaaggatagatgggagaagcagtttgggaaggtagcctagacaaggtgatggtcttttcaggaagttctcaggtgtctacaataggtagcagaattgggcctgagcaaaagtcacatgagcttacagcaccctgtgcagtcaaactctcaacttcacttaagctttttctttgctttgcttctgcccactcacctggcctgttaccacccactgttttaagcagctcttcagctgcacatctactgtcctgctctgccctgaaataggatgataggtaggactgctgtacccacagtttacatgtccttaccctccatgtaaactgtgggtacagcatttgctacctaccgtgcttctcaaataccggaagcatggtttggacagctgaaggcttagcaatcattccaagctgcagcatctccttgggcctcaggctaacacccatatcaaaacaacttgcgcggtggcgggcgcctgtagtcccagctactcgggaggctgaggcaggagaatggcgtgaacccgggaggcggagcttgcagtgagccgagatggcaccaatgcactccagcctgggcaacagagtgagactccgtcccaaaagaaaaaaaaaaaattatgatatttaaagagcatatttaaccattaaaatagtaaatatgttgctttttttttttcttaattgaactgtagtgtccttattgttttaagacttcatcgtatattctggatacaattcctttatcatatatgtgatctgtatgcattttttccaagtctggcttttcattgtctcaactgtgtctttcaaagagcaaaaattcttaattttgatgaagtctgacttatcagttttctttttagtcaattttgcttttgctgtagtagctaggaaatctttgcctaacacagtcataaatattttcattttttacattttgtgtttaggtctcccgtgcattttaagttaatatttttacatggtgcaaggtgtatggattaaggtttgagaacagacagacaggaatgtctttcagatttataaaacgtaaatgctatatagttaagcatttaataatcttttctgaaaaggaaaaaaaaatgcctacatttgaaaccattctggaaaatgtaagataatgtggttttcctaaccaacagtagtcagcttttaaatgcagtactttgactttattatcttatcattgagattcaccatgtttttatgtaccactaagaaagaaaaagaaaaaaactgattaaattgtttaaaaaaaaacaaaaaccttgaagacaattttagttacctccaggctaatcatttcctttttcttttctttcatcgcccctgaaactcccccaagcattatccaaggtgtgggctctttttggttagtaaacttcacttgtcatctcctttgagtgtgcttccccactctcgtcatcttctgctggcttaactcgaagcccaaatttcttacttgtagatggttaacaaatattccacattctctgcattttcttcctgcatttggaacctgggtttcctttaaggacaccaactccttgaagtcacactccccctttctcgcacgcatacacacatgctcagacaatgagggtggctatctggcagcttccacctttcccactagagttttcaaatatttgccacactatgccagtgccaaaatttatataataatctatccttcagaggcttctccccttgagctgctcacaatttacccctccttctaactcacaaggagttacaaggccctggaaatgtgcctccctcgacagccacaagtgaaatagtcaccaggttcatggtcttactcgaatccctgtcatgcagggatttcttcatttgcttggaatgactcatcaaacagcctagctttacagttccttgacctcggctcttcccaggacttttatctccatatgtcgacaggaatctactttcttggcacttgttactaactggaactgtatctattatcctttctcaacaagaacctctcatatctcagcatccttctaaggctcgcttactatttcacctcttctgtacttctaactttgagccttttattcccttcctatttgcaagcttcctaggcttcatttttaggaccccaatgttgatcacttgaatttccctttcaccagctcactgactctcttggcctttcaactcatcctttttacaaacccctggagcaggtctctcatcgcccttcaccactcctgcagccagtcagaacagctggtcaaatgaatacaggaatggactcactcattcataccaacggtgttcacttgacctgccataacagtgtgattctacaggccctgcaagttcatgctgactgtatatctcactcttctgcctcagagctagagaaaacaacactgaaaatgaccaaacctcctaatcaggaactggtaaattaaactgtttaaaaaagttctctttatatgtgtacatacataatatataacttcacagaagtgagcaaaagtgattacactgtatgtataaatttatggggagaaatgtagcatctgaattcttttcctttttggtttagtttccagttcccctcttcccattctccacaccaacatcatccctcacctcataaacctacacctagaaaaactatgtcaataatctagaatgtatctgggattttttcccaagttcatatgcttaaaaatatatacacactcatacatataccatcatatacttataaacacacaagcatactgtggatatacaggcttttgggctttgttttaaaagatgagatcataatatacacatcttctgtttcttgcttttgtcattagatatcttgtagatatcactctagatgaaaaggttctaactatttttagatctaattattaacttgttcctttgtataaactcgtaaatatttattgagcacctaccatatgccacactgaagcctgggatttattcaaatttcagaattgagaagggagtagagagattcatagtccagctctcttacagaatagatggaaaatcaaggctccgtaaatattcgtgatttattcaaagtcatgcagccagttgatgccatgtctcaaatcaaaatctagctcttgctagcccccaagtccagtcctcttttaatcatactattcagagtcccataaattagcatacaattacttacaatttaatgtgaaaacatactacaacataagataaatcttcaggcctggagtagggagaggatagggaggggcaaggattcaggaaatttcctgataatggtttgttgtctgtgtggatagaccaaattgtctttaatgaaccaaatttatcaaccagtgaagactcattaagatgcccagcatttaaagggagatcaataaaagagagaacttagtattgaaaagctatgaaagagctttgaatgaaattcactctccgtcttagcagagcgcttttcaagagtgagaatcatgggtgggctgtgagggaagatattccctggccatctaagcacatctggaaaggtccagatttcaaactgtcgctcttttgtcagtgctgaaaaacttaaccttgagcgctaggaagatgttctccaagatgctgaaacttgtcacgttatatgagtcttcatgttcataggcaaaacaaaacaaaacaacaggcatatacatgacattaccttcttttttgtttgagacagggactcgctgtgtcacccaggctggtgtgccatgatcctatcatggttcatttctgcctccaactcctgggctcaagtggtcctcccacctcagcctcccaagtagctggaactacaggtgcactaccctgcctggctaatttttttctttaaattttctgtagagatagtatttacctatgttgcccaagctgatctcagactcctggcctcaagtgatcctcctcccacctggtatgaagcactgtgcctggccttgaatttcttaatgatgtttttgtgaatctatttgtcaagagtacaactgccagatttttgtgcatttgtgcccctctgctccgaagtaccctgactgtcagtctattcattcagtcatcaaataactttggggcatctattctatgccaggcactactatggtaggccttcaataaagggaggctatgtttacatgggccttccacttcacaggcaagaaccgcactactgaatctcccgtgtctttgtccctccagataatttagtgtgcaccttatgaccttcactgacaaaatagcgaagaatgaacaaatgttccttaaagccagctaattctttggttattttaaagctgattggatcttttgtacacattctaaagactctaaagagagtccttgaaggcataatttcactgaaagacatgcaccacaaaccccctgagacatccaactgcagggaacacctcagctcagtcagtatgtgatgagctttcatgtcgcagggcacctgacagttggatgaaaaattgctttcagtctatgctgggttttctgtggcagttcagaagcaggactaggttctgggtctttactgtgtatgtcatcttttctttcagggttctgtgtttccatgcaaataattataatagtgtagaattatttgatacctactaagtgtcagatttcctgccatgtacttcacagacttttattctgtacaacaacattatgagtcatgtaatatcatccccacttcagaaagaaggttcggagaggtggggtaagttacacaatgacagaactacaagaggcagagcaggggtgaagctcagatccccgtgtctccaaacccaaggctgagaccgctggctgcactaccccacacagttctgaggcagaagagaatcaggaggtgaggatgggaactggggaaggggttatgttctgatgagttagtttttaaaggagagccagattttctgaagcagaattttaaacatgaataggacatgttaacttgatgttagtgaaatatttcctagagttggggtttattgttgaatactaaactcatgggagtactgcataccactgtggaaaggtgaacagaatgactttagggaatgtgacagtttacaaagaaaaaagtaaagaaaggaaggaaaactagaattctcagtcctgaccaaaactatctctaggataattatggtttatctaaaacttgtttctctgggtaatcagataaccctgctctctgtgagtgtagacttctccacatgctgtatgaggatacctctgtgtccctgtagttaacaattttaattataggtgaagtattcaggttaagtggcctaaattgacactttacatggagaaaaaagtctctcatgagactatatgctataaatacataattattcatatttaaactcaacattctattgcttttatatttgttttatattcatttttcacaaagtttcctttgcaattgattcctgggtgatggtattaacatgtcagtattatttattcaagacaagtggaaaatctcaagaaaaggctaaaagacccttgggagcttacctagtgactacaacagaactaggaattaaatggctgtaaagtgacatgttgtatacaacacaacataatttattatgtgttgcattaatataggcgttttgaggatatcaacattagctgaggaatcctgatgtctgccaattaccattgtttggtaaaagattgggagttctggatttaactgcttggtaatgaaatcaacggtttgcttcaagttaatgttatacagtagatgcctagctgatttcttgtttcccctactatctaccttaaacgcattctgggtctcccttcatctttgtaggtttctgagctatttttgtactgtctacatatcttgattagctaatctgtatattaaccatatgttctgacaagagttcagtgacatggaccctcagcccatgacgctcactaccactgacatgttgcatgtgagtggtggggggagatgaaattagtttattataatatgacttttgagaagatatagcaaaataatcctctaatccattctacagaaaaccttttgtttttccaactttattacctttcattattccatctcagctgttttcactttgtgagattgctagggtcaatgggtgaggatctgccatgggtgtgtgtgtgtgtgtgtgtgtgtgtgtgtgtgtgtatgtgtgtgtgtacttttcactgtcaattattctaagaaaagcaaatgctaaagtgaagtgaaacagacaatggttcacagtaaatatcaagctgtgtttgtattgctgccatctctttgggagaatttcttatctgttcctacagaaaaattactggaaatatatatcaatgaaaacgtataaatgaaatcctgaaactatataagattcatatctcttgattatccaaaatagagacatattattacttatgaagatgaaatgtttgtggtttgatgctaaaacatttagtactaataattattccatatagagtgtttgcattaatctcgactacactaattcagagcatgagctctttgcctttgtgcatgaagacagtttcttgggcaaattaccaatgtaatttcctcgttgtcattccgcaaaccatctatgttcaaatattttaaaagcagctgtacagaaccaaataatttatattttaattctatataaatcaacatatacttctttacttggacattaccattttaacttcaaattcaacatgtctattttgaaacccttgatttccaggataaatcagtctcttgctgacttcccttctcttttgtttgtggtagaatgattcccctaatgttggagccttaaagtctaacttagtgactcctctcatgttttccatatctagtctggggcaacatccagaaattcttcctgttctgtttttcaactatctttttagttttatttctagtgccgccatctcagacctctactaattcattggaattatttttcatctctctgtctaccatttttttcttcttccaattcatcctatgcatcaatgtcactctattttttcatatctgcaaaccactcagtggacatccaatatacaagcaaaccaattataggtgaaatttaaaaatatttattgtaatttataaaagaatagtaaactaaaaatgaatggtaataacagcaattataataatggaaaacaactatgatgctaattaggaggaggaagaatgttttcaaagtctttcaccaggtatcgatattcatctcaaagagtttgaacaacagattcaattctgtgtagggaccatttcttcatttattctttattcctactaaatcagaaataccaaattcataagtcatttggaagggtaacaaatgtttgatggtttgtcaactagtcttgacaaacggattctacaatgtacagaaattatggagacagttttcactgatagatgttcagtgcctcaaaggaaactcattaagatgagggaatgccctctcaaatgtaacaggattgttgaatatatcaacacaaaagatcactagcaaatggattcctaatgaattcctggttgaatttgcctctgataattatgtattcatattcagtttgagcattcagatgtgttaaatatggccaataatagcactgatttatttcctcctttaatttagaatatctttaagtagttagaaggaaacccttgttaactaatccattgacatcaaaatttaactttttaaggaacttttgctgtctctcactaaatattagaaatgatgatatgttgttcatgaagtcataaagtcaggcttctccactctctgtttgatttttatgtgtatgtgctgctcataaaaatcatcacactggtagagattcttgttctcacaatgcagattcacagtgtattttctccctgaaaacttgttattttctttggaacctttatgccaaatgatatataatttgcagtactattttcatgtctttctacttttacatctccgatggattaatgttgcagcattaattcattttgtgtgagttggtactctaaaatacaataaggcagacagctttaaacccatgtgatgtttaatatcctacaaagaccaaagagtcatagtggatatttccctcaatctaaaaataagggaaaatactaataagcaaattatataaaaatgaatctgcttaaatagacagcaccctgtttgccagatgttacctgagacaaccaatccatatatcccatgtatgtgagatgtttaaaaatgtaagaattactaaggacatgataaatttttatgagaatcataattaatcatatagttcaaatttcatggtgcctgtctattgccaacccctagtttttcacaggtttcacattggaaagcaatgggttgtcctttggcttattttattttagtaattaactgtcctttaaaaacaataaaactttcagccttcagtgactttgataacctatgtgataaagtcagaactcattagcctgatattcaaggtcttcccagagaggctccatcttacctgctctgacttctgtcttatacctgctgatccacctggggtgtctgctgaaagcaggtcagcacaatgactcagattcttccctttctttccctctcccatgccccaggatttgtttgtacaactggcccaggaatcctgacttcatttattctctatgggttaacccaggttcttgcttgtgaatggaaacaggataatggagctaaacctaaatggcattttctaaccatgtcttcattattcattctctgaaccatcctctctaatcagtttttactgatttcttccccaaatatgcatttgctttctcatttcaacttatatttacactgttctattcatcagaaatgtccctgtcttgtctgcctcgtcaaattcttcaactcccaactcctgtcttacttcctatataaaatcttattaggttaccttagctgaactatcttcttctttctggaattcctattgcaattacttttgttgtaattatttaggcagtggtttctttgatatcatttactgtgttttctggcaattgcactgaaattgtatactgctcttcaattaatgattatctatttccccaaactagattttaagcaccttgaggacaaatattgcctcatatgcctgtatttctgttccaggtctttggcatactgttaataatgaacaaatattatattacagtaaaactgtatcccaagattttctcagactcatctaaaatataggcaagaacttaataacactaatatgcctgttcaatgaagcattctattcaaaatgttttattaattctttacagcttcctcagcatctgattggaatcagtggcattttaatttatatgtctatttaacaaatactaatatagtgtgcactgtgtgttactcattttctatgcactttacaaataataattttatttaactttcaagacaaccatctgaaataggtgctattattatccctgttttatgtatgaggaaatggatttactgagaagtaactcagccaaggtgatggaattagttactaataggttcaggatttgaacctacatttttaaccactgtgctctaggaacttagttaacagctttaatgaatgaaatggttctgctaattgatgtaagaaactacttacatgttttgttggctaggtcacctgtcactctcagttcagaatctttcaggaaatgtcctttagtctctggtgggaggtgtactgcaactaaccgtcctttgaatttatgttgccatgtacagtccctgtaattttatttcctctttctatctttacttttgggatctaagcttccttgaatgtttagcctttttgtctttttagaaaatattgttccctttatgaatatgtctcttaattgctagagtttcctaatagccaaatgaaaattacattttggcttagaaaatgctttcatctgtatccactggctatatatctgcaaccaaagtaaagtgtggaattgggtatttgttgtttgcagcatttgagcagtgtacacatcaaatgtggttaattctattaccagtaatatttctagtttcttctaaaattaccataaaggtttaggtctagattagataattatttccaatcaatctcctttcaagttggaaatgaatgaagtcccatgttttctgtgtgctatttcatatattttggcatgataattattaatagcaatgtattactattgctcttttgcttacttaaaagtatattttgcagtggtttattttattctaggtgggagaataacacgttgatatcttcttgaaataaaaattatatgtcaatgaatgtgacaatgttctatgtaagtagcaatcgaggaatgactgaaaagggattattaaatatttcaatgcatgggaaaatatttcttctacctatttactgcctaaagtaaatgctaacccagaagatatttatgtcttggtttagaaatctgtagagtgacagagcaatctgagctctgtaatgtatgcaaaatttatcaggctcagagagacatgagtatgggactttggccacataccatacctgtgcccagggacaactgttaggaaacattttgttccagactagttgtgtcacctattatcttcatgttcctggaatttgtgatacaaagaacaatgtatagccaatcgatagcttatgtatttgaaagtatattcttggtaaacaacttaggaactgcctcttgtttttttcctaaaaaaacccacttgtaatggctggtagttggagtgtataatcagagcaacttgaatctacgctcctgagtggccatcttcaacaatcaccctggaataaactctttttaaactagaaaacaaaaacaaaggaaacaacaaaaaagaagaaatctatagagtgaactatatttttccaccttgcaaatagaaggggcaaaaatcaaccttgcctatctgatgatttagtgtcatagggattccaaaatgttatttgtaacgtgtaccttgatatgctaatggtgaaatctcctgtttcttgatttggtcttctcatcttacatttcttacctcaaatccattctgcgacttcaccagcagattaatattctttcctggtctcttggaattttaataaaaacagcatggtcatggggtttcatgaagcttgcagccctctgggggatgcagataataatcaatcaatctcataattaaatgtaattttaaataagagcttacaaaaaaaaaggaatatggtgataatagagcctagacaaagggatattacccagttagtagatgtgtatatgctgggcaaagggattgatatttaaataatgtacaggagtcatctaatcaaaatggtagaggtggtgggtgaggaaggatcttttgtgaaaatggaacaacatgtataaatatataccatgatgggcaggagcacagagattttgagaaaataaagctgtggtcgcagtcacagctcaaggagacagtgggagaagggaattcggtgaactggtaaaggtggcaggatcatttggtacctcataggctctgattaagattcttcctatatctttagagctgttgaaactcactggagtcttcaacaactgagtgacaggattagatttgaaaagatcattcttgctatggtgtagagaatagtcattcttagatcattcttgctaagtcttccatgagaaagtgagtaacatagatttgaaaagatcattcttgctataatgtatgaaacagttgggaagaaggtaagttatgggaagaccatttgaaggctatcacaaagagaaattctgatcatttagattaggtgatggagagaaaggatgaggaacccagaagatagtgggaattaccaaggcagagatgtggataatacagtccatgactatagaacaggaagtgctgaaagagcatgtttctgcacatttagaattaagagggatttggagcatctggagcagaatttgtttgttgggaatgatgactcgggagaggcaggtaggggccaaattatgaaggtccatttttgtgatgtgatggcaaaaggaacaactgaataaattgagcagggaatcacagtcagatgtggagtccagagaagtctctgatggtgtggaggatgctccacatctctcatgaaattaattgagaaactgctatttttttcatctaagagttttaattatctttcatttagttcccagaggctattgggcataggcacctagtaagtaactgttaataacaacatgcttattttgggcatggcaatgtggaaatttattcctgccgagtaatcagtgccagttttatgctggcagggttttaaaagaatggagaagggattcttttgcctccattaggagaaagctgtgccttctcttcatcatatagtgactcattcaaggttggcacaaagtaactttaatcaattaatgtgaataatatcatacctttttaagcctaaaatggatattagaggctatcagccccctggaaaaaagtctgcagaatatttttctttcaatgataatgtcatatatatcatagcccttgaatctttccaaaacatttagtcaatactgaaaacatccctagagagacactcatccaatttctcacatgtgaatcttttatctatctttggaaaattttaagaagtgcttaatttcagactgcttttataaaggacataactagtagcatggtaaaagtgcagtccatgaaattaaattcctgatctgaacctcaggtcaattaacttctaaaaatactctttttgagacaggatctcactctgttgcccagactagagtgcagtggtgtgtgattatggctcactgcagcctcaacctcccaggttcaagtgatcctcctacctcagcctccagagtaactgagactacaggagtatgccaccaaacctgtctatttttttaaatttttttgcagaaatgggatcttgctatgtttcccaggctagtctcaaactccagggttcatgtgatgtgctctgctgggtgctatactgggctgacaaaggtgaataacacctaattcttctccaaagagagcgctcttcaactgatgagggaaataaacaggagagcaggcagtgaatgatagagcagtatcagaggtgctaggttgaggatcttcacaagcttctaagtcaggacatcctaattcaaaccaggaaggatcaaagaagacagtaaagataatgaccacaagttgagtcttgctataagctgaatctggaagatagaagtgaaattgtccatgaaaaaggaagaaagaagaatgtcgaagaccaaaggggaaagagagtaagacaaggtaaatcaccttttgatatcgttgctgagttgtgtgaaaggctgtcaaagtgggcagaagtcatgttcagaagagttttacattcaaattaaggagtctctgttagacagctttaaatccatgtgtctaatatcttacaaagaccaaagactcatagtggatatttccctctatctaaaaataataaacttttctttccaaagggaaaaatttttacttatgaaaaatgtggtaaaatatagaataggaaattctgaaagatacaagttcttcttgaacaatgagcaatgtaaaaatgataaaattattgcatgatacaatcttttttaaaaaagagaaaacactgagcatcttttccttaagccccctttcataaaatctcatattttgcccacttctccatcttaatgattgtggatttctttctcaagacctacttaatacatctcagttggaatttcgaaatgctggcaagtctttaaaaatagacagatgatgaccctaagacatttggaacttatcctaaaggctgaggcacagtagagaaaatatattgaataatatacaattttggtcaggaaatgaggaactgctaggttagaggccccattttctgtgtctggacactggagagaatgcttgtgtttggtcctccaattaagagctgcatgatgcctgtgccctgcaatgccaacacttattgggaacccataacctttgcttctccaacttctccagccaagattatgatgaaaaaagaggcaaaccacaattgccaagtctgttctcagcaattcgttcactggtctttcatcattaggcacattgcccctgtgtacctttggtcccaacgcataaagggatcttgcattgtaagcacatcatatgtttatttaaagaattttgaatctttgcagctcttattgactgttcagcagtgaaattagctgttgaaaagcatttgcactgggggtcgtttctggaaagaaaagaagtatttcttaccttcttctctaagactgcacattccttgggggtttacccatttgagactgcaagaagatgaaataactcacttttctctattaaaaggtgatctcaattgctatagagagaagaaataaacaattattaatattcctgtgtcagagagtgtttataaaagcaaactgtgaggttcgtaatctgtttttagacaagaaaaagatttaaagaatgacttaaagtgatgattataagaaaataaggagaaaaaggagagagaggagaggttaataggtaggggaaattgattctagaccaagcacttaagaattctagttctatgtttgatttcctttttatacatcttgcactttgctctaaagcaaaggagttacaaaatttttaggcaaaattttctacccatgattagcgagcatttatagaaagaagcaataagttctttcagttgaatacacccagtacctctaaaaattaatgtaaagagcacatttcatggtcactaaaagaagggtgcaatttaatgtatgatgttaccatttattactaagaggacctgatacacaaaaatataaattactttttccatatcttctttcagcttcaaatgattttgattttttttttactttagatactcagagtagaatttataaagacatttggggagtatttctacctcaaaggaaaacaaaaatataatgacatttaaccatttcagatatttcatgatatgtagttagttttgtgtatgtttctactacattaaaatatccaatttattggttgtcttgaaaggcttttgttttctgcagagattggatttccaaatatattaaaataattgcagtatttatattgtccgttcttaggggctgtacttatattgcatttctttgcagagttattgatgatgtatccttgttctgcagtatggcacttggcaaaacattgcttcctagtttgaactctccaatgtaaccttcagggggaaatggttctagaataccattgcatcaactcttttagcaaattgcattattagacatccatttataacttatcctctaagtgatctcagtcgaatcatttgctgtcttggtttcacttctatgaaatattctagagcaaatgctgcccttgcttgtgtcataggactgcagtgttggatgccttctgtgaagttcatttagcccctcataatatgcattccatgtaactaggagggaattttctttgggtagatttctcagataagttgtaaggggtggtgtgactggctaaagtgcatcagtaagagatcattggcttgtgaggagtgcaaaaggcaggcagacaaggggaagaggaagtggaagaagccctacacatattgagcaccagtccacaccacactccccatgaagcacttttcatacattgcctcatgtagactttgagatgactctgaaatctgggtgttattagaggccagagatctcaaaaaacttgctctagacacttcatacaaccggtaaagggtagaattggcatttgacacaaatttgactgcctcctaaacttaatacattttctgcaaagttattggagacaatggagcatgaaatatttcttagtttcaggggttgaagtatcatctgcacttagttttcttctcaaataagataaactctaaacaacaataagaaaagtagatttgtgagttttgtacgaattggccagctattaatatcatttggcattctaaaggaagaacggctgaagtaaaccacaggtgcagatcaaatcttgatgtctgtttcactgcaggagacaaatagaatctctctttcttgtatgcttctgttatgttgagtctaaatctgaggtaatcatgatcatttcaacctgaggtatggtttactaaattaggagaaacatacaaaagtttgttgacttttaagctaaagaaggcaaaagccataagtgaaacaattcaagtagagtgctataatgtgactgtttctaatgacaacttgaattgattgtaaaataagtctggcagttaaaatgtattagtgttggctgagcatggtggctcacgcctataatcctagcaccttgggaggctgaggcgggcagatcatgaggtcaagagattgagaccatcctggccagcatggtgaaaccccgcctttactacagatacaaaaattagctgggcatggtggaggctgtgcttgtagtcccagctacttgggaggctgaggcagaagaattgcttgaatccaggaggcagaggttgtagtgaggtgagatcacgccactgcactccagtctggtgacagagtgagactgtctcaaaaaaaaaaaaaaaacatatatatgtgtgtgtgtgtgtgtgtgtgtgtgtgtatgtgtgtgaaattatgacagaatttacctgtaaggtgttagtcatggaatactatgcagccataaaaaagaatgaaatcatgtcctttgtagcaacatggacgcagctggaggccattaccctcagtaaattgaggcagaaaaagaaaaccagataccacatgttctcacttacaagtgagagctgaactgagtatgcatgtacacaaagaagagagcaatagacactgaggcctacctgaggatggaggttgggaggaggatgagaatcaaaaaagctacctatccggtactatgctctctacctgcctgatgaaataatttgtataaccaaaccccagcaacatgcaatttacccatgtaacaaacctgcacatgtgcccctgaacctaaaagttggaaggaaaaaaaagggatagatgttagattattccaacctcagcattttaaataacctctatgactttcttagataagtaatagtaataccaaaataattagagagtggtagagttccatcaccaggtctttaccttcattttaggaataggttaaggcatcaagagataaagtaattaataaaggattatgctgtgatctgaaacacaagtacagtatttgtatttctgagctaagactaaagtccagatttctttcatttcggtgcttgttcgtttataccacactgccccaaaggacactaactgtaatagtactttgtcctgacatttaggacgcactcacacccttttgtccagatgtttctgtcttagatttccttactaaacactaggattgtgaaacctttcctttcctttctagggacaaaatggtattcactggcatatctagtttaatgctttgcgtacagggtgtgccacagacaattgggttaatggttgtaactggttaattgattgacacttaattttcagagttcgaccataactaaagagagatgagctccttgaggagcttcccactcccctagtcctcttctgctgaaaactactgggtcctcaatttttcctgaatacaccgctcatgtggccacccctaactgacccagttgaccatggatccaatttcagccactttgtggattggccaaaactctaaaaggaagcttaccatcaaaatttctgtccaaaaaggaatgatgaacaattatctaggccaactgaattcttctttactctggtactgaaaacatataaaagaaaggaggaaatctgagaccacaaggtgggaagggttataagaatttacagaagtcacaatgatgagaaagcagaagatatgaggtggagaaggtaatacatacatagcaaagaagttgatatcgactagatatggcagctgcagtgaggccagagatccactgaattgctgcatatcacaaaagtggagaaataataaacacatgattctgagggaataagttagcctgtatacttgaggtgccttagatcctatgcttttccagttctgcttcccaagttcatgtaccattccagcaaattccggaattcttttcatactattcattctacaataacttgacccctctttttgttgacgatgactttctgttgcttacaataaaaagaccccagtagctgggcacagtggctcatgcctgtaatcccagcactttaggaggctgaggtgggcaggtcgcctgatgtcgggagtttcagaccagcctatccaacatggtaaaaccctgtctctactaaaaatacaaaaattagctggacatggtggtgtgcgcctgtagtcccagactcaggaggctgaggcaggagaatcagttgaacccaggaggcagaggttgcagtgaagccgagattactgttgattactgttacactccaacctgggtgagagagagactctgtctcaaaaaaaaaaaaaaaaaaaagaacaaaacaaaaaaaagcctaaattatacaacaggatccatgggagaacatcttgatagctttttagcaggaacatcacattccaaatgcttgctagctattttctgagtatcagttatatttaccatgatcctgaggagcagaccctttattgtgtcccagttcagtttgcatcgtcttcatacagcataaggcaacagtgatagaaataatctctagagtaatctccaagtacctttccaaagctgctatgcctcaagtacttcctttaacctttaagcgtctgccttgcatacagtcctcttgggccactcttggcaaaatatttggaaggagatctggaacctgattatttctcaatgaaaaaataatttgcttttgcactgggaagcgacagtaatccaatataagcatgccattgaaaaccttcatgccctactatttcttttaggacttttgtgaaccctttctctttgatacattacctttggcaatcatggtattccaggacgtgccaatgaagttggctgaatctgaatggtcttggaagagtggtttgtggttggaatttctcttgcttgttgatatatgtactttccatgttggactttgtgcttatgtgaattctccacgtctcaaaggcattatgtctagcaagcaatttctcataaattcttatccatacagttattctatgagagcattgcaaatatagtcagattaggctttgatttgtttttcattctaatgctatctaacaaggggatgttctgatttgtgtagccctgtgcctccaagaagttaacggtaccagatacacagctcatttattttcattgtgcccatgtggttttctgaagtcacactttgtgttgttttacatatgggaaaatggaaacctggctaacttgtctttagtaagtgattggtggagaaattagtagaaactacatctccaaattcctgatctaggtaatgctgtttcaacaagctaagttgcatttgaattttgaaatacccactctagattgcaattaccaaatagttgttatgtacccaatcacaggatatgcttttgaaatttttttcattagtacatggaagagagagttttatattgtggtaggtagaaatgcccagacaagacaggactgagataaattaatggccagtccatttattttgataaacacaaataggactaatgcaccttgagctttaggaactagcagggcatttctagttgcagcatagtcacactaaggtgcaaagagtcaatggacaagcaaaaatgtgtaagaagaaaataagattctttgtttgttttctttatttgacatatttaaaagaaggcaaaagtgtatcttccaaaaagtacattttgtggtagacacttttcctctgctaaaccatatgacatcaagtggcatcccttttcttcctttgtggtcattctaaccctgatcccagattggacaaggttgaaatatcagcatgaagtgaagttggttctggttaaacttttccaggattgtcccatcttccagtccttgtaaatgagtgtcatgctttgttgccaagtcaatgaggagacaatgttcacatggagacccttgggcacagatgaaactggaattccttctcacccatttcatacagatagtatgaaactcatttcaactgagaagtgaaaattctggttaaggaagaattggtacttgaaagttgttactttaaaaaattatcttgattcatggttttacaagtcagttataaatgttaatagcctccatcactgtcatgttagctgttgtttcagaaaagaaatacatattgtagtagttttaatagaaggagtaggacagtaaatgtaaatgtctgtcctaatggattgttttatacattagagaacaattttttaagtgatcgagtaaacaaagtccccctcctacctccacggtgattgtttctcatagatgaaaacagttttctcatcctgacgacgacaacaacttcttcttcttcttcttcctcctcttcttcttcttctctttttctctttctttcctctttatttttcttctttctttcctcctcctcctcctcttcttctgctgcttcttcttcttctccttcttcatcatcattatctcatcatcattatcatttcagtgaccagttagtgagcaccttcatgtccaagcactgtctggggtcttcacagatgttatcctaatcttcacaccagtttaatacaagtgtgttaatatatttgatatgagtgctaggatatagtatttggagatgagggaagctaagctcaaggtcacattctgctggaactggatttgacaccagagctgtctgattccaacacccacactcttccctctgccatatcctgtgggtgtgtatcaagttttctcccttgcctgtggataggttgcctattttttaaattaagctcactctttatttctttccttctccctcctccttccccaatttcccttttctccttctctttctttcatttttttcccaagatgatatttacctgcaatacactattgaaaatttctctatgcttctgccctgatctaatacaatttttatcaagggaaaaataacatttactaactaatacctttccctgtagaacctgatagaaaataaagcataaaatttaaagtttatgacacactgcaattcatccaagggcgtctaaatgttcaaagaggcacaagagagagataatttgcttttaaaagaaaatgaggccaggctcagtggctcatacctgtaatccaagcactttgagaggctgaggtgagaggattgcttgaggccaggagttcaagaccagcctgagcaacatagtgagatcccatctcttaaaaaaaaataaaaaattagccagctgtctatttaaaacaagaaagaaagaaacagaaaatgggaggaattcaacttttgattagattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactagaaagactcatctttttctgaaaaactttctaatcatatatcacttattttagttccacatttgaaagcactgttgccacaaaatcacctattcttttactgattttattaattaataaaagacattgtgtaggacagtatatttgtcataattatgggcagatataagcattagctccattgcaaaataggattaaaactgaatgtacagtgttgtcaagtatgaaatatttttcccagaataaatgagtagagaagcatttaaagtctccaaaaactccaaggggcctaagtgggctctcttccaaaaaaataataataacaagttatgatcatattaccctgaaatagattcaattacccaaacaattagtcagctaacaaatatttatcaaggctcactcttctaactgatctgggatacagaaggattgtaagaattagtatcctccctaatggagttttcattctagtatgagagacaaaagtaacacttaaaagctaaaattgaatgagttagttacaaagtctgtggggttgactcgagtagagggtggttgatcagtgtaggtttaatgaaattaaaatgagtaagattctataaatgcaagactggccagagaaagtggggagctctggggccagaacagcagaggaccaaaggcatcctacacagccaattaaggaattttcctactgaagcatggggtccagggagcttcatttgtaatcccttgttctgctttgtttcattcttggactctaatatggtttgactgtgtcctcacttgaatctcaccttgagttataacaatccccacgtgtcaaggttggtgccaggtggagatgattgaatcatgggggcagtttcccccatactgttctcctggtaagtaaataagtctcattagatttgatggttttataaaaggcagttcccctgcacaagctctcttccccaccactgtgtaagacatcccttttctcttccttcatcttccattttgaatgtgaggcctccccagccaatgtggaactgtgagtccattaagtctctttcctttataaattgcccagtctcaggtgtgtctttatcagcagcatgagaatggactaatacagactccatcacagacctttgggctaaggactttacctctaggcacctgccctattacttctattaaatggtgtaaacacagtttgctcacccatgcaattgccttactgtgattcatcttgaagtctagcctgatgacagggatactatgcaccccacaaccaaccctactgagtaattggctccattaaaacaagagagaattgtgagataatctggatagagttagagttcacaccaaacatagagtttccaatttaatggattagtttcatttttgcaacattcagtactgataggatgggtcaattttggcagggtctagttgccatcttaaagcgaggtacagggtgctatttagagcactttgcagcaacaaagaggacaaggtttgaggataattctaatagctcttatacaaagatattgaaccaagtaaatttataatatgtgggtctgcaaagtattcatgtttcttgagaggagtgcttcagattgagagacgggagcaatctgtaaagaaggaacccaatggatggacactggggaatgaatatcaaggacacagttaggtatgaatttaagctagatgttcacttaggtaactgtagcctggagtggaatgacaggttagaagaagtctcctaggctgggtgcagtggttcatacctgcaattccagcactttgggaagccgaggtgggaggatcacttcaggacaggagttcaagaccagcctgggtaacataataagatcctgtctctacataaaatttaaaaagttagttgggcatggtggcatgtgcctatagtaccagctactcaggaggctgaggcaggaggatctcttgagccaaagaggtcaaggctgtagtgaactatgattgtgccattgtactccagcctgggtgacagagcaatactctgtctcaaaaaaaaaaaaaaaaaaaaaaaaagacttcaaatagcttacctatgaagaagctgcttggtaataccttaaatttcccttctatgcttttacacagaaccctaaccttgcagttgaggacttgagtcatctcacaattcttttgggtaaaaaaaatgtaaactactgtgacccaactttctttacagctgggaaggcctctatttgattgaaaatataaattaagatactaggttttaagttaaaatattaaattacctctagcttttaaaaatcataaagatctttctttaactaacagtagagggatctagtgtttcaagtattgaattggtttaactgagcaatttctgaatgtcaaagcaacagattctctaataacatcttttgtttttctaaagtttattcccatattatgttatattatcagagagccatgtaaggggactatcttactttatatccccatagaatttccttcccagagttacaatttaacattttgtcctcagcttttttatagaggtcaatataagaaatagcacaggaagaatctcttctcccctctgccctttactctgggcagaattaatcctttacttgtctatgtatatactgtgatttatatatactgctatggtagcacttaggtaataatattattgtaaggaattttgctgtctgagataaatcttccctatattctcccctttgttttactccaaaggactataatcctgcagagtttttcactaatgaatttaggcattatttttctctaaaagaaagatcacactgaaaattatataaaataggctgttttcctgggatacccttgtggcttgttagaacacccggagtcagctggactggactgccactcttcttcacttactttataggcagatgctattccttttagagactgtctctgaaagtgaggaccctgggttatgtctgatcgttgggcggggagggggctttaaggttctaatttttgtatgtgtcctatttccatgtcttgtttcccagataaactatttccttctatgtctctgctttcctgaagacaaaggtacctttttctcagcagtggagttggagaggaaacagattcaggaagagtccaatattactaccattattgcaattgcgtagtagtacatgccaaattcaccctgtcttttcattttacttacctttctcttgtcccacatgcttttattcttggcatgcttacctacaaaattatcctttttttctatttccgtattccctatgccctgtagtcttctttcaaagcccctttgaaatgctatcatgaaagacggatttcttttctcagtgctgtgagcacctccatctcctcttctcttctttcacggtgcccatttcttcttcatctcatcaagtatgcagtcctttcttcgtctgcactgttatgtacctccttccacctttgtttcttccaaacttgtatttcttttgtctttccatttaacaggcctcatttcttttatcttaggaatctattcataaaatttatacagtctttaaggtgcaaacaccttgaaggtagagaccatattatttctatgttctttatattggcactccaattaaacaaaagtctatgtccagttgaagtctggaagcctgataagcacactgaagtaaaagtcgcaatacacatgaatgactgaaagtaggttttgttaccagtggaaaagacatttgtgagaacaaaatgacacataaagaggaagcaagtgattactgacttactggaaatcccaggccgggcacggaggttcattcctgtaatcccaacactttgggaggctgagatgaggggcttacctgagctcaggagtctaagaccagcctgagtaacaagtgagaccctcttctctaccaaaaaataatttaaaaaaaattagccaggtatggtagcccatgcccatgcctgtggcctcagctactcaggaggctgaagcaagaaaattgcttgagctggagaggtcttccagcacctgaaagacagagaaagaccctgtcttcaaagaaaagaaaagaaaagaaaacccatacatttagctcaattgactaaaagcctaaatgaaaaatatatatctttcagcttaaagggttggttggattgatttgttgagtaaggtattactatttggacaattgtaaaaaggacctgtgaaagccatattttggcttggacaagctcacccaccccatgccccatctctactaagggggggtgggattcactgtcaaaagagttcttctctttaaattctatacaataggtacagtaattatatctaattgcatttgaaacacaatagttattaaggcaaacgtttctagactagtttcattattaaataaaaattgaaactgagagtttttcccatattggtaaatattgatttaattttttaattgaatgggaataatatgggcatttttttatcatttgcccaaaatattttaagaaaatactatatagtgtaaccttttttttttttttttttactatgaaggcattaattttgttttatttttagtacttgcttccagttcacttttcaaagtgtcctttaggcttgttagtttcaaaggaaataatatatttccttttgacttaaaatgcctatgctatcattagatattaatagtagaagtaacagcaggattgcctggcacaaatttgtcctgtccttcttctggctaggcaatagggtgcaaatgttccttgctgtgcttttgatggtgaaatagaaataacgcttcacattttataacacattatatttcataaagctctttcacattcatcacttcatttaatcatcaaaaacaattctgcaaactgatattatttttcacatttaagtgtgagaatattgatgctcaaggaagcaatgatttggctgaggacccaaagtgagtgtcagtgccaagacttaaatctatttcttctcactcactccagagtccttcccacatcatcacactgtctccttctactgtgctttgctctaacctgctgaactaactagcaagtgtctttagcatactacattagatagctaagacttactgaatgcctactgtatgccaaatcctgtcttaagaacttacatgtgttacctaattcaatccttgcaacccatgtatgataggtaatattattatctccatctcgcaaataaggaaacatagaatttaaataacttgctcaggaaggcatagccaataaatggaataagtaagtctcaaatctggacagtctatcttgagaaatgcatgcttaatcaccatcctctattgcctcttaaataatcaaagcccgtaaagattttataaatgacttttctcatgaataatagggcctggggtgagtttctcaatatcacttatggcaataagaatttcagcaatcataatcttggtgcattttccaaaaaggatggctccccattgggtaacacaaggtgaaatgtgtattctgttagaaatttttgattccagcctagggaggtatcaagaataatgctgttgccataaagatataagtcttgagacaaacactggagaggttcagtcattcaatcaactatacatatattactgaacattttttatgttcaaatgctgtgctaagtatctgaataatattcacatgaagctgaaaatctatcaaaaatacatttgaatacagatacttggtaaaatctctaaaatgcacaaagcttcatggacacatgaaatttctttactatggagaaatcaaggaaggtttaataaaagtagtaacattagagctaatctttgggtaaagaagaggaaaagacaaattgtagtgcatgctgtaactgtatataggttctttggagatagctcattgaatgcaaactttcagaactcacttcatgagtcaataggaactttacacaatggtgagaataaagtgcatcctttcaaagcacactgtccatggcgtgagagtaaccaccacactgacatttgttgaagaaaggttctcctgggttctccccactctaccctccttggatgccaattaggcaccttaggaaggacaagtgtcttccctgtcccaaagaattgatttttatagatatttatatctacttttgtgaacatgcaatgttcattttgattattattaaatcaatgtaaattctgaatgaatttctctgacttttactttgcttattaagttgaagactcaagggcaatgcagatgagaatttcagattcttcctttgagaggatttttggtcagtggctctttaagaagacccaaagcaggttgggtatacttcgtaaaatcagatacttggtatatagttcttttttttttcttttctttttttggtaacatcaccacgaggatttctttgctgaaatgcactgaccttctgtaaaaattaacactggaagtattttccaatggaaattgactaataaagaaatcaataatgaaggaatatttttagactggcaagaatcatgatgacactgttaagaagaaaacattgtacatatttaatatgtttaaattccagatcctcaatattatgattaagaatttaatgatttttgtttataattccttctcattgtgtgcccacatcatacttagcttaaattatgtatctaaatatgtcttctctataaagtttcttgtggtcagaatcaagtggtccactagtttcatttagcagtagatgtatatattttgacacataccaaagaagtgcagctcagtacccaaaagatgtactaactgaaaactttagttcatgtaatatgcccggcattcaccctcgcggaatttagacaggagggattgtggcctgtatgtttgacttctggaacttaccttagtaaaattcaaaaaacaggttcattagtaatttcttcaaagaaatctgcttcaatttattcagatgttttgtagtctctactttgtattaaatataaagcactgagttaaagaggtaaaaatatcaaaatgaacaggatagtctctctcctctgggatcttataatcatgtaaagaaacagatatgtaaaaactgtaaaaaagatatgtacaatataattataatataggaaaattaaaggccatacattttgtaaataaacagctatgggaacaaaaaaatgtgcatttttttttctaattggcaaagtctaaatgggattgtggaggagcagtttgtatttaagcctgcaattgaactacatgtattatttttaaaactggagatttgaagggaacactggtggcaaatagaattgtatgaacaaaggaacagagatttggaaaggcagatggatgtcagcatggctagaggacaggtacacagctgatggggcagaaggtagctatgaaaggtttgcagaagtcagattgtcagtttcttttaaagcctgctaaatgtgtacactttattgtgtaaacagtggcaaacagtaaaggttttgaactgtaatgatgtagtggtctgggctaaactattcagagcaagcattttaggttacagtaactgaactgtgggtttttgtttacatgtatccagagttgttccctacctttgcaaggtcagtgtctcagtgatgtgccttaaataccttgtccttgaaatagaacctcaacatcttcaccttgttctttttttttaaaagaccgtgtcttactctatctacaggcatgcaccaccatgcctggctaatattttatatatttttaaagatgggacctcactctcttgcccaggctgatcccaaactcctggcctcaagcaatcctcccacctcagccccccaaagtactgggattacaggcctgagccaccatgcacagacttatccctctcttaaaaaaatttgttttcaacaaattcatatgagtaagattaagaagaaatggtacaaccagacataagctgaaaagcaaaagtctcctttcctactttgtttattttgcttcccctttcagaggaaactacatttgatcattaaaccaatacatcatttatattcattttttcaaaatatattaggttggtgcaacagtgattgaagttttgtcattgaaagtaatggcaaaaaccacacttttgcacctacctaatataaaacttcatttttgttttgtctttcatattgatgaaccatcatttgtttatttttttggatattggattgccttcattgttttcactattataaatacccctattacacatacaaaatcaaaataccatttttgccttggctttttaagaaaataaacgttgattttaaaaacaatttcagatatacagaaaaattgtgaagatactacagtgaattctcatttccctctaccatgttccccctattatgaacatcttatattagtgtggtagatttgttacaataagtgagtaaatatgaatactaattattttttattgatatctgatattatttggctctgtgtccccactaacatctcaccttgaattgtaataatccccacatatcatgggagggacccagtgggagataatttaaccatgggggtgggtttttcccctgctattctagtgatagtgaataagtctcatgagatctgatggttttataaaggggagttcccctgcacatgctctcttgcctgccaccgtgtaagacatgactttgttccccctttgccttctgccatgattgtgaggcctccagagccatgtggaactgtgagtctattagacctctttcctttataaattacccagtcttaggtaagtctttaatggcagcatgagaaaggactaatacaatatcaatagatattgatatcaattatttttatcataatttattcagattttcttagttttcacctttgtcttccaggagcccatcctggataccacactacatttattcattatggctccttaggttccacttagctgcaatgttttctcagacttcctttgttttggacagccttgtcaactttgagtaatactagcagggatactgatgttttcctaagtaccagactggcgttctaggtttagtaaggaagttcacagaggtaaagtgctatgcatgatatcaagtatacatattatcaacatgactttataccattgatgttgaccttgatcactgggctgaggtagtgttgtcagattactccgcctgaacatcattgacttttcccctttccattctgtactgtttgggaggagctcattatacacagttcacacttaaggagtcaggaattactgtccacccactggagggtgaaatatctacataaattaattgaatttttttttcttgagatgaagtcttactctgtgggccatgctggagtgcagtagcacgatctcagctcactacaacctctgcctcccaggttcaagtgattctcctgcctcagtctcttgagtagctgggattacaagcacatgccaccacgcccagcaaatttttgtatttttagtagagacagggtgtcaccatattggcaaggctggtctctaactcctgacctcaagtgatcctcccacctcagcctcccaaagtgctgggattacaggcgtgagccaccatgcctggatggaattcttttgtatggcagatctatttcttctatcccatttatttatttattaattcatttatttacatcaatataggcttatggatattcattttatactttgggttaccatccaatatgacttcactttgttgcttaaattgttccagctttggccactgacttctgtgcccctctgacgtttcccatcagtgtgggatttttttttttaagcacttccttactttctggaacgacatgattctccaggcttatcttgcatattttctgcttcaacattaggcaaccagttcttcaaggagctatgactcttttaattggggaacagaacaaaagccaagacctgagtgctaagtgtgattgttactattggggtgcccttgcttctagagcttctcagctgataaagtaaagaaatttatgtgtgtatactaacttgtgcctgcgcacctatctataaatatttctatatgtaaacttctgtgtctacattaagctaaacatgagtacattttggtgtttccaagtctaatatattaccacctggttagtctagcctattccccttgtttttttctgtaaaatcctacaccaaagtgagaaacatggcttctaccttcctctatccattcacataattattaaattctattgtatgcttgtagctgaacaaaatttttaacccatattgctgtaggaaagacactttatcaactagagagtttgagtttatgtgcagttcctcttccttttagacttacagactccactcatttccaaaattactgttaaccacttttaccttcagtgaggttgtagtgtacatttgtgatatagttatattcttttggaacagcctgcattccatcctgtgataaatatgtattgcaaactctaaagaaacctttttaaaatgactaaaaagaagattaaagatgcagtgatgcgggaaatcagtaaggatataaaatcagtaatttgacctgaacagcactatcaatcaatttgttctaattgacatgtatagactattccatccaacaacagcagtatacacattctgctcaacctcacctggaacattcatcaagtagaccatattctgggccataacatttatcttaacaaattcaaaagcgtggcaatcactttgaggaacttgtccagagggtataaggaaaggacaaacaaatgaaatatagaaatgatagaaaaagtgaaataaagagaagacattgtaatgttaatgtccataaaatagaaatacaagaagcattaaaaaataaataaatcaaggatagaaaatatttgaagaatattgtattcaaatatatcttataatttttgaaattataaaagcattaagaacccaaatttgagggtttcataaatggttaacaaaataaagaaaataatcctttacctagctacattattgcaaattttaggacataaaaggcaaagagaacaaaacaaaacattcaaggagggaaaaagaaacaagtattcaattgttatatttctcaccagttatggtggatacatgaagataatacgttactaaagaaaaagtgctttaaacctgggaatttatattttattaaaatataaaatattatttaaatgtgaaaatgaaacaaatttatttttagtttgaccacttaagatgtgctttgaaaataccattgaagatgggatatccataaaatggaatattattcagcaataaaaactcatgagttatcaagccacaagaaacatggaagaaccttaaatatacattcctaagtggcagaagccagtctgaaaaggctgtatgattgcagccccacgaccttctgggaaagggaagaccatggagacaataaaaaagatcagtggttgtcaaggattcagggactggttgaggatggagagggcagtggatggggagggaaatgggtagaacacagggcatattgagggcagtgaaactattttgtatgagactgttatggtggatacattgcatcatgcatttgtgaaaactcataaaagtgcacaacaccgagagtgaaatctaatgtaaactatgacctttaattagtaataatgtatcagtgttggttcagcacttgtcacaagtgcaccacactaatgcaagatgtgaataatagggaaaaactcgggagggtgggggctgggggaaggtgtagaaggaatacatgagaactctgtgcttttggttcaacttttctataaatctaatactgtttaaaaaattaaagtctgttgattaaaaaaaattacaccccagaaagaaaatatatccaggagaacccaggaaaatatgggaagtatggatgagaaaactatcaaagctatcagtaaggtatattacttataaataaacaagaaacaaaagagaaaaagcatacacaaaacaatccagactaacaattctcaaagacagaaatgtggtgtggtgggaaaaatgggatggagagtgtgaacaaagtcatgatgagacctcacagaggcaaaaatgtactaggatacttgtcttgggggcaatataaaatcatgtatataatttaagggtaattaatacaagtgttcatttaatacagtgggaataactaaggaaaaataggatttgagaatataattctcaaaccagaagaagaaaatttggtatgaccaatgaaaggaagaaaagaaaagaaggaaaaaaagaaaggaagaaaacatatagagaaggaatagaaagggaaagaggaagaaataaaggaaaaagggaagggaggaagaaagaagggagggaggatggaagagaggaaggaaggagggagggagagagggaaagccaaaacaggcgaggaatgatgagaaggatgggtagctgttctgtggattgtgtgagttaaggggaaggaagtggtgggacttaacatcagctccatatgctacagagtcaagtatcctcacatattcttacattttccctgaagttatatattgagagccagtggaagacatcgtagaaattccctggtctattttgtgaatgtgtcttgtagtacatagataattacatgtgagccattcctataaaaaggtttagattggtcaaggatgaaagaaaaagagacttgcaggtggaaaacaaaaagggcaataaattaaatctttcaaaataataattgctgaaaaatagtcatcttaagaacctcatataactactagtttaaaatattgccatccagttattgaaaaaagcaatttttcacatcaagaatttttatttatcttaaaatatttcagaggcaattggtgttatgctttagacacttgactgacagtaaaagtttactataataattcaaatgcctcttcaaagtggatgaacagaaacaaaacgttcagcgaggtgagtgttaaattattattatttagtgggaaaatgacctgaactattttctttggttgctgttacataatccataatctgatatcagttccattttgttgtttgtatttgtgcttgaactttcaatacaatagaggtcactaatggaagcctaaaaaagaatttttatttgacttttggttcattagaagtttctttgttctagttattttccttagcagagtgaatttctctcactttctcactatttgtccaatttactacctaagcctggatgtttgtcttttcatactctggaaacatggacaaagacaaaacatagggagtttcgaggcattattcaataactacctagagaataatggctctattttatatgatctaacttggtcacttgaatgggtcatatttctccaatattcacagaaccacctaagttgtttttggttgtgtggacatagatcagattgcctttgaatcatgatttgtagatgtaaacactatttattagttgtaaaaactttatattatctttaacagcctggccaaaaggtcattattgtttaggccttctgccttccagaaagagtatgactaaaacagatgtattgggcagaatttccagaaataccccaccacccccaatttcacagggctaatatccagaatctgtgaatgtgatgtcttttcattcccatgattgtcttatgtgatatgacgtagttgaccctgaaagggtagggtattcctggcagacctaatctaatcacagaagctgttcaaagcagagaaatttctcgtgctagtgacagaagacgaaagcatcagggaaagtcagaggaattcaaagtgtataaaggacttgagctgttgctggtttgaatacagaggagccacatgagaaggaaggtggttagccatgggttgctgagagagagattcacagctgagcatcagcaaaggaacctggagctcagacctagagccacaaagaactggattctgccaacaacctgaatgatcttgaaagtggtttcttcccccacattctccagattagagcccagtaagccatcaccttgactttgaccttgtgataacttgaccaaacctagctaagctggccaggacttctgacccacagaactgtgaaataatacatgggtgttgttttaagccattgagctctggtaatcagtaatatagaggcagacaataaatatagcatctaaaaccagtagctgtttattttgagatgtcaaagaggatcccattctggtgtttgatatttcagagtgccaggccatttttcctcacatcccactgacattcctcttgttttgatttaaatgaatagtctcccttagatgtcccagacaggattataagtctctttccttaaaagtttcagttgttaagatatgtagcataaaattgtatactataatggatcttgtaaatctaaccatttgctaaggtaacacaggttgtaggaagcaaatctggtactagaagccaagatgaaggattttcaacctagtgacctttctactcaaaagccatactggctctgaccttcatattttaattgatcaggcaaataatctcaaatcctccaactttgtttgattatttggctaattctgctcagaatcctctctaaatatctactggaggcagggacattaactgaatttgaaaagcaatattatggtaagactctctctaataataccataaaataccatagcaaggttgtttttaacagataattaaatgaagtccaaaggaaataactagcttgcccaaggttactctttgcaattgagaaaactgaggcttgaataggtgtaattattcattcaaatgtcctcggccagttcatggcagagatagaaagtcgatccacatctcttgatttccaattctttttttacactgagctatgtcaatatgtcaattctatagggtttgccctcagattagtttgagaaataaagtatattcacagcctctgtgttttcagtgtactaccagctgggatatctatgacttagttccaagctgtgatattctctgggactacaaatttttaagagccattttaaaattggctagaaggcaaatctagggtgcccataatgactgtacccagccctgctatgagtgactgcactgtgatttattccctactcagtgcccatcccccactccaaagccctacaggatttaggaaaaactgctggaagaaatgctacatcatgaaagcttaaaaaggctcagggaacaccacacttgaatcagtataggtgggactggtatatttcttttgctatttcattatccattttgcagttcttataaaaaatgagtctgttgatgtagtcttctgaagcattaagatatatgctatttctgcagtgaacaggctgcttagtgaagaagagtgtcggctcacttttgttctttcatatatttattagagtacgctttcccagagtgtcgattgcatgactttattgaagctagtttgaactcagactttcccccactgaatctgagatccactgaggcccagacaccaaggagctgttacacatgtataactattccattcacacctcttcaggagtttcaaacaagtttaattataagagaaacaaaagaaagcacttcttctttgccactgctaggaaaaaaaattgctttgcttggaaatcaattcattgtaagctttaatctgcctagttcggtttctcagaatgaatatttcaaatattaaatattttcttgagtagaatgtatagtacatattttatactaatatctatgtgtgtgttagacaattaagaagactggagtgttttccaaaaacttgaaaagttttcggtgactcgtaatacagaagtgacatttttatttgagaacaatttaccagattatgtcaagttcattattggtatgatactaattatccttaggataaattggaaaggggaaccctctgctagttttctgaagagctgcgtaagcctgatgaaatgtcttttctctttctgtgactcaaagctccagaaaaatctgcaaagttgaatatcacttgtgcctgctaatcttgtgtcatagttattttctatcactgtcataatgtcagagaagcactgggaaaatctgcacatcactcatctctccttcttcacccttatccaggtatatccacatatatccaaacatccagaaggtcacaggtgggatatttttgaagatgtactcacttcagcacaggtgaacctgttgatgacttccaggtctaaatatggtgaccttagtcacactggttatttttagggagcttcctctgactctcttataaactcaagatgataaatgcaatctacctgtaagattcttgagaaatttgtgttgtataatatgaccgtatatgatcccagtagttgtgtggaacttgataggaaccacagtaagtatcacctctccttgcttccatcattcccctactccaacagtttcatcttcctcttctgtttctagtgaataaaacatagtctgctgattttaaggtatattccattcccagttgtatacacaatggttaactttacattcgtgcaatcagtcagtcaacatttgagtgtgtactctatgtcagatgctgttttaggtgctaggggcccagcagtgaacaaaacaggccattgctgtgctggaagtaaaattctagttgggggagacataaaataaggaaataaataagtatataatataaggtaatatatacaaatgaaaaaaataaagcaggaaagagggtagggttttggggggaagaggatgttaaaaagttctaatggtctaggtatggctcattgacatagtgacctttgagcaaaatcgtgaaggtgaaggagctttactctttgaatcaggatgtcaggtcttagtttagactcttcagactagatcttagccattgtttatagatttgcttaaatgtctaattctttttcagctgattatgttggagtttattgttcctaatgaccaatatgctctaccaatgtcagaggcctgattgacttttgagggacaatgactgctccagtttatgcactttctctccccccagccctcccatccctcccatcctcctctgcctaccctccccaccccactcactttttggggttcctttgtcagctgtgtattatggcaaggatcgacattttcttgacattcattgtagagaaggtgatgtaatctctccttggagggtggtcacctgctgcttgcaggctgagctaaaagcagattctctcaatgacaggtatgactgcatttcctgggcaccttcagcaaacaaggctcttgcaacaatagcttgcgtcttattcttaattacttcataccccaaattaggtgggctaaatatctttttgttgtcacagaatggaaagcacatcataattagtgtaaaacaaatatcctcatagggtccaacatgcagtatcctaaaagaaaacgaagtaaacaatttatgtattttgtaatatacatggaatatgccattaggttgttttgcaaacccatgtaggtgatcctggtagattagatttacaatatatctttcctttcacttcattctctccatcctctatccattaatttttcttatatctagaaatagggcactaaagaaaactacagtatacagttcctgctttctctgaaatcaactattaacttcaggcaagtggaacacatacttggtacattacttttttttaaatccctgtattgcataatagaagagaatggtaatttttatcatgccattaatgtgattcctttctttattgcttaaagtgtcaatcagtcaaattgaaatgggttattactctgttatcttcttcattttaattatttggctctcccagcattacccttcattacctgttctccagaggatttgttttatctgaaaataatttactgcttaacatcgatgcatttttctgatatcgttaggtgggcctggtgttacatttagagagttaccgtcatcagagtaagaggaaatatatacagtgttttatcttgcagaacttaatgtaccaaatctgatgtcctataatgtttcagagggatgatacaaatcatttgcaactagaagctgaatattcagccttgtcacaagaattctcccttattcaattagattttttaggtgtttgctttaaaaagtaatatcagattagtaatggggaagcaatctttgaaatcattggtgggccaaaccatgataataagatacaaaagagaaatgaatggtgggaaatggcagacacattacacataaacattgttttgttatggcaaatctctacggcttctcaccacgatgtcagtacggaagtttgaaagaaaaatgtatgcgtctcccgtagagcccatgaacttgttttcttttgcatattatagaatctgcaggtatttttcaaatgaggaccacaaacattcaagtattaggttttcttacaatgacagccaatttagcaagcccaaggttttagagcatccttcaagaggctggttccatttgcacgttcatgttcaattcgcaaagcaacagcagcagcctttacgtatcccacgattaacacttcaacctccagcccattttgtaaggttaggcattcatcaaaatgtcagaatgattacagtacagatctaaaatcccttttgtcagacactggactttaatccgctcttttctgtagtcacgtcctgtcacttttgcagctgacaattattgtttttggtcaaaaaattgtaccttgcaatcaaaatggcttgttatccaaattgatctctgatgctacaaaatgttgtttgtggacaattctcctgagcaccactctccctctcctccagagtttacagttgaaatggaagcaatagaaagtcaggagaacagggtggggctgaggcatgcctggtcttttcactgctaggcttggatgcctaggaaatttacctggaggcttctgagtaactgaacctctaaaagatattaaacgagactttttcactattttattcatagtttgtgcttacttttaagtgagcttttgttttggaattaaaccctgacagtcagtggcagctagaatcgccacctgtcaaaagtaaggtttccagtaaacaaaatatttacatatatcaagtgtgagagagactggggaaaaatttaatgggcaaacagaaattcatagaaggctacaaagtctttcttgaccagtctcacttgtaggtcttaagcctaagatgccatattacaggtggatcagcttcgggaggaaagcaagagctttctattggaagcaagcaaacccctctttgtgagtttctttgcatttgaggttctataaattttggagctaaaacagttagtcccttatttttgtttcactgaagctgctgaatgctaataggttattgatgatggttttatttgccagccatgaaaaatgcttggacaacaggacatgcatgacagttaatctttgtagagagaagatgagcatcagtggctgaattaggtgcggagggttgcagatgatatttaggaacacagtgacatcaagggagagggtagcccatggaactgctggccataaatagttttaggcatactaaaaatatcaggagaggataggagagactatgtggaattgctttacaagaatggcagcttcttaagaattataatgagatcagaaggtacaatgcttttcagtacttagaggtttttttctagatggaaataagcaaaagtagagaattaccagggtttacattttgtctccatcatttatagctaattgaacatgggagaaaacgtagcttccttctaaggctcagcttcctcaactggaaaattggactaaaaaagaaccatacttcagagttgttaacaggattaaatgagataatatatgtcaagtgcctagctcaatgtttggcacctcagcacatgctccagaagtggtatcaattattattacataacagagataatatttggtgggctatgtgtatttgtgagtgagagggagaaagataactgttttttttacgcatttttgtgaatgtataactttctcccaactcagctgaagcatccaccatggagagaagtgcttcaggactgttaccagagaaattgaatgagaaagagatgaaaccattttttaacatccctaatgggaattttcagtgaatggctagacagtaggcataaaagccaaactgtcatcagggaagagtctttatacaatcaattatcaagatgcctgatggataaactagaccacaagtcctgcaggaggacttgctgggatggataaagtaaggaggcagtaggtcatcccttctgttctgaggaatgtgagaggaggacaggaaggtaggaagggcaggagagtcttcctttgcagactgtatccaagactggaaagaaattttaaattagtaaaatgagataccagcagcaggaagaggaaccactttgctgaccaaccctatacccactgggtaaagggagacagagcatcaaagtgatcccagtgatgtcatgtagataggcacagagaaaatgttggtgcttagctttcttgagcatgcctgctaataactggcatggatgggactgaaaagttcctgggttgcctaaataaaatacaaaggtgataactgctaagctgtgccagtatgaaatgaaggcaggccaaggcctccacagagaaccaccagccctgattaaactataagagactggccaccagattccagcatcagatcccaggtagggcgccatacaggagagaacctacaccagggactggcatgatctcagactcccatagatttggaaaccctgtctgtccactaccctatcatctcaaaactcactacattctgtacactcagtgcaatctttgaggggaacagagaaaagagagaaaatgggaaatgatgggattaagctaaactgacatgatagactaatcctaatcctattccctccctattcacctctgtcatcaccagtgccacacagaaggtgggagtcatgagaaagacacaatgcattgtacataaaaggaaaaaagctgtgtcttcaccaactcaaaataggaaaaattgtgaccctgtgatgacaactattacagctgtcataataaaatcaagatgatggctgtatttctcaggcctcacatcaccttttcttttacaaattatttgaaatttaaagtagttttttctaattctgtgaagaaagtcaatggtagcttgatggggatagcattgaatctataaattactttgggcagtatggccattttcatgatattgactcttcctatctatgagcatgggatgtttttccatttgtttgtgtcctcttttatttccttgagcagtggtttgtagttctccttgaagaggttcttcacgtcccttgtaagttgtattcctaggtattttattctctttgaagcaattatgaatgggagctcactcatgatttggctctgtttgtctcttattggtatataggaatgcttgtgatttttgcacattgattttgtatcctgagactttgctgaagctgcttatcagcttaaggagattttggtctgagatgaaaaattcatcctgctaaaaatgcttgatctggtaagccaagtgctagagagactagaggagccaaggaacacgtaggtagggtgagataacagaagaatacccaagctgaattgaaaggaggaggtgcaaagaagcttgtgcattggattaggaaaaaatatagactttgaactcacaaggacttgatttttttccaatttgtcgtctcactctctgcataacctctattatgagttgaattttgagccccccaacccccccccaaaaaagatgttgaagtcttaaatcccaacacctgtgaatgtgaccttaattggaaataaggtctttgcagatgatcatcttaagatgaggtgattaggatatatcctaataccacatgaatgtatctgtgtataaaggggaaatctgaacacagagacagacaagtccaaagaggatgaaggcagtgatcaaggtgatccagctacaagccaaggaacaccaaagattgccagcaaatcaacagaagccaggagagaggcctgaacagattctccctcacagcatgcaaaaggaacgaaccctgccaacaccttgatttcagacttctgacctctagagctgcaggatgataaatttctgttgtttaggccacccagtctgtagtgcttgtaatgtcagccccagcaaacaaatacagcctctcaactatgtctcatcggtaaattaattatttctccccaactcataccataaaatattttagacagcttgcacaagcccccaaacaaaaaaactgtgatgaaatggctaaatagtgtagtagccatggtgtatacgaatataaacagaaacatcgtaacaggaaaaaataagaaagtccattagatgcagttgagcttccagcttgtctcttagtttcctggaaaccaaagtgaaaggaggtacctgtttggtcagaaaagttttagtattacaaaggaaatagcattgtatttctttaggggaagcaaaaactttttcttagccctaaattctacaggcagtgctgaattgctcagtaaacaatgcacttaatgatatttccttggcaaatttggtgaattatccatacactggtgtgtatgtataacatggtagtgcaacccccaacctgaaggtgacacttgtgcgcacgtaaatctctatttcttagagatgtcaaatcaaatcttataaacataagaaagctacataagcatcacaaaaaattacaaacagctatgcctcattttcataagtgatgtcctgactctatctgatctagttttcatgtaagtcctttgccactttacatctatcctcaaaagcctaacggaatctggctggataccccaggtgcttcctcaacgtagaagttttctcttgtttgtttttttttttattctgagttattttgaatatatcagtcaattttaatctaaacttgcattatgttttcaaatacaatataagaatttaattaaaaacaatgcttcactgacagcagctctacaattctgtatttgacattgtagtacaacatgcaaaggcatgtattgaggtcagtctgaaatgaaacacttagcctctatattttttggaaaaacaaatccaaaatatgaaacattcagataggtaggcataacattcagatgtccagtgatggaggtcttgctttgaggggcaggctgtttcaggtataaataaatctctcaaagtctatttaggaaaaagatatatatatattcctgcaacttcttttgtttatttttattttttgtagagatggggtcttgctatgttgcccaggctgttctcgaattcctcacctcaagcaaccctcctgcctcagtctgccaaagtgctgggattacaggtctgtgccactgtgactggcctctgtaacttcttaattctgtctgcaggagccacatggaataatttatttagtgctttaaatatatatatatgtcactaagccattttaaggaagataatcagaaaataattatcaagctgttttgaccaatataattcagattctacttcaaaaaattacaagagattgcctgaattattttttatattaaaaacatagcaggcatatgttacacaatgagttttgttctgtctttcatttgttaatactttcttaggatgataatagaaaaaaaatttgagaatttatctttctctgtaccatcaaatctacagttttccgttgtttattctcagtcatttccattcccaatttaaatgttggatataataaccagccatattaaaggcccgattctatgaatagaaaacatgaaaaaaaatttaagcgaggatttgggagatggtggtaggtaactgaacttggtaataacaataaaatgatcccaatcagaggctgttgtgtgagcacagcctgtacaattaatagtgacacttcagcagcaaagccactccaagaatcataccatcgtttgccattttatatttctctccaagattttccagagaaatgccatcaaaagcacaaatactatttctaggattccaaactctaagaaacatattaattcagaagatgttaaagcatcaaaacagagaggaaaatgttggaatggttactatttatgactagcttctgctctctgcactgaagagcgtagctatttccttcattttacagttgacattcagaaaaagtacattaaaagtacccagaaaagccttatctctgcatatttttgcaatttggaaggacaaatagaaacaacattagaacttgatacatttagtcgtactctgtattgtagacttggagtggaaaaactgtattgtagactcggagtggaaaaaacacaaactgttttccctccgctctcacaccacaacaatcaacacagatgacttctgtgaccaaatgtgtagcagcttctccacaccaacaagcaataggcaatcaatcagttctgcagcagacaccagctgggtgtcatccagtttaattccaacacagcctggatggagatatcatcagatcccacagcttaaaggctcagtcccacaagaccaccgttcgcttcacatggcagtcacaggccctgggttgttttacatgcgcttctgaccaattgtctataaatcagggttcccatgaccccttccttgtgttcaatgaatttgctagagtagctaagagaactcagaaaaagacgtgactcagtttgttgtaaaggatattacagagtacagatgaaaagatacgtaaggaaagacatggggcaaaggatgtggagcttccctcctgggcacaccaccctccaggaacctccacacatttggctctccagcagttgtctgaacctagtcttttttgtgtttacagaggcttcattacgaaagcatgactgacaaaaccattggctattggtgagcaacttaactttcagcctgtctcccatccctggaggttgggggtgggactgaaaatcccaaccttctaattctgccttggtcatcttttggtgaccagtctccatcctaaagctacctaggggttgccagtcctcagtcaaatcattagaatatgaaaatatatcattttggaaaccctaagaattttaggattgtgtgccaggaaatgatgtcaaagaccagatacatgttttataatatcacagacacatgcataggttgtccaattttttctaagtgaagttaaaaagtatttcaaccccaattgtcctattcttcccttacatcattccttcctatacttctgtctaatgtaattaagaagaacatcgaggggaaacaacttttacttgatcagagaattaactgaactattcacttcccaagtgttcaactgaaaggtagattattttatctcatcattttaggattccttttcttaactgatttgttgtttatattgagtaaagtacaccaatattaagtagtacatcttgaaaatgttttacatatttaaaggtaatagctattgtattttctattaccctatattaattttgtctgtttatgagccaaaaatagattgttgcagaaaatatgtactctttgtatcttatttctttctctgagtaaaatgctttttattttcatctattttctttcacacagcagtactttatcttcttttatattccactaaatgtatgaaatgtatgttgttttttcactgtcatgttgatggagatatgggatgattccagccaagggctgttacaaataaagttgatataagcattcttgtatatgtcttttggtgggcatgcatactgatagaagtggaattgctataggtagatgtatatttagctttaattgatactgccagactcttgcaaaatagttgaactggtttatattctcactgacaatgtatgagagttccaggtgctccacatttaatattgtcagtatttttaattttagccattctagtggatgtaagttggtatcatattgtggtttttaatttgcatattcttgatgactaatgatgtttgggacattttcataggcctcaactgtttgaatatctttttagtgaagatgttctttcgattttttgccctttgaaaaattggtttgttcatctttcttattgatttggaggagttctgtttttttttgagacggagtctcactctataacccaggctggagtgcagtggtgcaatcttggctcactgcaagctccgtctcccaggttcacaccattctcctgcctcagcctcccgagtagctgggactacaggtgcctgccaccaggcccggctaattttttgtatttttagtacagacgggttttcaccatgttagccaggatggtctcaatctcctgacatcatgatctgctcgccttggcctcccaaacagcagggattacaggcatgagccagcgtgcctggcatggaggaattctttttatattctgcttacaggtactttgtaatgtatgtgtacaggtactgtgtaatatgtttttccactctatggcttgcctattcactttattaataatgtcttttgatgtacaaaatttctttatttggatagagcccaatttataatttccttttttgtgtttagttctttgtgtttgtttgttgaaactttgcttacctgccaaatcacaaagatatttttctactcttctagatggttggtgttttagttctgtgtttagatctgtatccacctggtatttacttttaattatgatatgcaacagggaccaaggtttttatttccacacagttgctatagtaccagataaccagtgctatagtaccatttattgaaaagactatccttttctcccattgatttgcagtggtgactatatcataaaccatatacctgtgggtctccaggtctatttctgtagtttattatgctcgtttggtctattctgttatctttactcattatcaaactcctccagcttcttgtacatgtttaagattgtctttgttattgtacattatttccatttttaaataaatttggaatcagattgacaacctcctccccatgcctaccccccaaaataaatcttctggggttttgaatgctattgcattaaaaccgtggatgagtttaagtttgttggaaattgacatcttaacaatatatcaagttctgcagcctattaacatggaataacatctgcatttagttagttcatttctttcactaatgtgttctattttggaatagatgtattatgcatgtttcattagatttattcctaagtatttgtttttgatgctatgctaaatggtatttttatctcactataattgttattattatatgaaattcatggatatgaaatacaattaatttttgtatgttggcctagccagcaaccttactaatttcccttattagtcattgtttctttagtattgtttatgaccatgttatgtgtaaataatgatagttttattttttcttgccaatttttgtacattttatttcctttccttgctttattgcaatgcttcattccagtataatgtggaatgggtgataatagacatccttgtcttgtccccaccatcagaaatgcactcagtctatggtatcatgttattaattctctagtgaaaccatagtttgtatttagtaaaacaacaatgtacatttggctatttcaagcttaattgaatttctttggcctctacatgattcttccttgctgaaaaggataatttataacaaatatttcattacttataaagcaaacacttgcatttcagaatacctttgtatttcactttcaactctagaaaatatttgttaggaaagtataatttatgaactgttataatgctttagtttctattcatttatttgggatttaccatgtattgctttaaattttaagcaatttttatatgaattgcttctactctacactatgaacacaaattcaaagatagcctgtatttgtattaaatttctttgaatctcttaaggcaactagcataatgccttgtctcaataaatatatgtttattgctttagagaaaacaagtccattactattttcaaagttgaaattgcgttatatgtttaagctgccatttaaacagcactacattttgccataattttgctatagttaacattccaagtatattcaaagttgatttttatttttttcagaaaaaatgccttagtctgtttggtattgctacaaaagaacacctgagactgagtaatttgtaagaaaagaagtttgtttagctcacagttctgcaggctgagaagttcaacggcatgaccctggcttctggcaggggcttttattctgcatcataacatgacagagaaggtcaaagaggatgcagacatgtgtgaagaggggaaagtttgctaggcatcttagccctgtaacaacccactctggtggaaactacccatttcctcaagaactaatttagtttagtcttgcgagagtgagaacttactaccagaagaacaacaccaagccattcatgaaggatctgccctcataacccaaacacctcccaataggccctacctccacactggggatcaaatttcaatatgagttttgatgagaacaaaccaaccatattcaaagcattgcaaaaagttgaaaaagctctactaatgtgtaaccagacatgtgaacatatataactttgagacatagcacaacacttaaaagccttcagaatcataaaaaatgtatctatcaatcttaatattttattaactcaaattatttttacctggctgcatggacatacaacatttaccctaaatttaaaatagaatgcaaattaatattcattggtattattttcattaattgcacaacatagtgaaaataatgttaacatttttttcctttccttcttccttcttctcttttgctttttttcttacctgtaaattaactgagttgccagatatccatagttatcaatggcaatttggaggctctcagaggcagaagtggttggtgtttttctatttattgttctagatttgggtctgagcacttttataagtgaaactttccaggtattttgttgttgttgttgttgttatatcaggtcttaaactatacctttataaattcttagtcatatatactaaagggcatttaatctcacgactgttatttatgggctttaagtcctctatgcaaagggtaaaattgtccctgtgaatttcagaggtagacattaggtaaagagagagttttttgcttgacttattgcttaagtcagagcgttctctgaatcttctaactcttcatttaattcacttgaaagtatttattaatcaatgtgcctaatacatagatgggactgcttccagtgagtctgtcagtcatgttaccagagcctttatttcttcctctatgccaagcttaaaaaatcagatgatttattttacatgagccacacatgcaaatagacctgtaatgctgaaattttgatacttaaaggtaaatctagtatcagagagctctattaagtggtctagagtatattcaaattacaagacatgcaacttattctaaaatctaatgcaatctactaacagcaagggagagggaactattcagagtaaataggacattgtttatctgaaattttattgacacattaattgacaactccattttatatgacgtatacaatcaactggacctgtttaatgttagtccttagataaaaaataattgtagctcaagacctcataattgtatatatttttttcactgtacctggtacaatcatttcatgtatgaaatgaatgagtccacaatacctcaatatttgaacattttgttttaattcacttaatcattgaaccacagagtctgtgctaaatgctattatctctataactcaacaataaggagatttaacagactcaccatttaatgtgcacgggagcacagatttcaaaatttgtttcagcacaaccttttggattatcatatatttgtaccataaaataaatcatctgattttttactctactgagacggatgcatatgcaacatatttatgtgcatatattcagtgttggaaattaattcataatcatgtatatcaagtgatttggatatttacctgcaccccatctcagggaatcattagagcttgcatttggaacatttaactgattttagttatgtaatgtaattttacacacattaccttacatttcccttcaaattccttctgaatcacactgttctgatttcctggaaacgcagttcaagaaatggccaagagtagaaggatgttataagacattgagtttcgaagttttcctttaaaatacaaaaagtgaaaattccacaaaagtggaatgaaacttgatttatagtgccgcaaagaaaaatcctggaatgtgcaggaaaggaagtgaatgaacttgggaacagctgcaagtaagtatgatgaacgactctgcattgggctagcagttcatctgttccacttgcagctgcaggccaaagcgtcaccaggttttctgcagaaactcaacttggcattttaatggctgaggtgaacccactggtggccagctgctgggactgaaaatcagaagcagctccagtccttccagattgtgaggggaaaggttaaggagagggaagtggtgccttgtcccagacagacgcccattggtcctgagatttcaaaaacaccaggagagagaatgcctggcagtggagaaaccaacactcagccttctctggaagaaagaaaaggcttgaggcaggattctcaagcttcatttaattacgatcaaatagggactggcagaagagcgtagctgcagatttgcagtaactctccctaaaagaacatgagctgtgagagagtgaccttgcagccagcactgatttgacattcacctgtttccctgcttgcattggaataccgctgggttagtttggatcccaaacatagaaaagtaactcctagcaggaggcagaagagagcacttaacattatgcggccaagaggttacactggctgctgcctcttatcaatgggtctttcaggtcctttttgggagcaatcctgggcttcattgccctgcctaaactgtagtttccaagcagtttctcaggcagttcctgttacattctgtgatcctgcctaatacagtaatttgattccagttgaaaacttccattacatacatgtcttgaatcgggagagttagagccttatactttgttcctctgcaaaactgtaagagcatcactgctgtattaaagggaagtgagtggaaagttgcaaagtgagcctttgagttcaagaaaacagatgaaaatgagcccaagccttggaactacagttctaagttttgagtggtggacagagtgggaaaccacgtagcatgcaaaggggagcggaagggcagaggaaggaagcaaggctacagtgtttggctgtgttctaatgtgctctggcatggagttatcgtgagtggaactaatattacataacactatgtatattttggaagatggctgggaaatagcctttggagccaatggagatttattaaataaaaattacctcaagcttgatttttcatctttaccaagcaccatagtaaattggcatctctgagactcctgcgggagccagaaagctggaatcaaaaattcagaaacatgaaatcaagaaagaactgaaaatctgaatggaaagccagtcacaaaagaataagaagtaaaatattctttaattatgtattatctcctacagatcaaaaggaactttccaccatttcattgaacctgtgagtgaaaatgatcccaaaagtatagagaaaataaagaacagtaagcaaattaattcagtttatatactgtcttttaacctgtttagaaagaatttgagaattgtttgatcctgattatataaaaaagatatatctgtatctatgtctacgtatatattaatacatacaaataaaatttctagaaggaagagtacacaattaacagtggttacttctgaagaatgggaatgggatgttggaggagacagatctgtcacttttcattttatatttctctggtgagatcaagggagcatcttactttgtaaatattaaaaatgctgaaatatgtaggttaaaatgtaattaatctacattcctatttttcagaattaatctgacttaccatctggtcatttttgcttgcttacattttttcttttgcaaaactcattatgttgttttgctaaaaacaattaaaacaatgcatcaaactagtaagaaaaaaaaagtctcaaaccacagagaaagactcacaattaccattagatacataaaattctatgatatatttctttgtacatttctggatcaaataatggcaagatggatgaactgatggatagatggatatatagacatgcatcgatgtaggcagacagtaagatcatagtataattgatattttaatttaacagaaggttaaaactgaaattttgcttttagaggaactattgacctcaaataaatgttttattttcaccttaagacgtatctttttctaaaagatccaaagttaacttgaaaaacatggaagtcgatttttttttttttttttattttaacctatcaagctcaattgactccctctcataaaagtggaggcacagtggctcacgcctgtaatccccgcactctgggaggccgaggcgggcggatcacgaggtcaggagatcgagaccatcctggctaacaaggtgaaatcccgtctctagtaaaaaatacaaaaaattagccgggcctggtggcgggcgcctgtagtcccagctactcggggctgaggcaggagaatggcgtgaacccgggaggcggagcttgcagtgagccgagatcccgccgctgcattacggcctggccgagagagcgagactccgtctaaaaaaaaaaaaaaaaaaagtgaagatattgccacaggtctcaggtcctctttccctgcttcactttctattagttttatcagttaggtttacatttactaagtttagagcatatacaatctttttttctttttttttttttgagacggagtctcgctctgtcgcccaggctggagtgcagcggcaggatctcgactcactgcaagctccgcctaccagattcacgccattctcctgcctcagaccccggagtagccgggactacaggcgcctgtgcaatctctatggtaaccacatttcccagttgactactaccggtaataaaatcaaatggattcagtgctcacaactcttcagtctttgggctactttccattcttgaatttttagctgaattcatctctttggctggattttgtggtaaagtagttttttgcttattttttcccccaagaagggcttacatgggtctttttctatgaattattttcctacttgacaatatttacttgttacttttttactttcatcatgccttgggcgcatataatactctcccttcacattttctttccttgaatttgtggagaattttccattttattcttgcagtcaactttactgaaaacaaatctgaaataaaattaatgttattctaccgtataggcgattggctttttagtcccaagatgcctaaaaataagttacccttaacacataatagcttaacttagttaggtctagaaattgagggtttgttttgtaccacattttctagaaagagtgctccttcaacctaaagatttacttagctttttttcaggaaatttcttggattagatcttagaataaatatttattttcatttgttaaattctctacttcaggaatatctgttaacattgtgttggatttttttgtttaaagtattcacttttctctaattgcttttatctccttatctgttcatcttccttcactataattatcttaatccccatttctctgtatcagtaacttaattttcaattgcatccattgtttttctaatttatgtattagtttcataaggctattgttttgagttctttcccccttatatcggtactctcctttatcatctaattctgttattctattattttgtctttgaattttgttttagtgaacttacattcctctattatattacattatattagaattagtagttttgagtaggttggttcatgagtttgtgagtagggtagtttcaagtagggttgagtagtatttttatgtttcttgtgataattttgccaaacaatgaatatttctttttagtataaagatgtctcatggaatatttaggacatgtatatgctaaaatttatttgttgcttatatgaatttcaaattgagctgggtgtctctatttttatattttaatttgctaaatctgtatgttttttataaatttccttccttccctccttccttccttccttccttccttccttccttccttccttccttccttccttccctccctccctccctccctaatctaggaggattttatagttgccatagcgttttcttttctttttgctcatgcttgtgtgtccctaagatgccaagttaggtgggatatattgtaggtggcctcttgactctcttctcaccatactgtttgttttctttacttaatatacagtctgagaactgaatttactttcatggattatctgtttgtctgtaatctatgggaatactgggtgatgaaggcagggatctagtcttagatactctgcagccttttctctgtctcctaagatattttttctgtgcaatgggagaggggtttttgtccaatcccctgggaaatactataaatgaataatttctcaaatttgctgtgtattcttgaatcttcactctcttcaaagagacttaagccactatttcattccgggtaggagcagctaaactaaactaacagaaaagctacaaattacagtggcttaaaaaacaaaggacatttttcttgcttgggtaaagtttcatttatttttccctctatttcattgccatgacttttagggagcagtgacttctaaattgtggttcttaatcaactagagtttatagtttgtctaacattttaaaaatataatcagtttctttactactatttttatattactaattcattaattttcacccaaatctttaagaacatggctctcatggttagggaaagaaaattgcgcaaaggacttgtgtccataccgtttttttggcctcactattcctgaatgtggtttctttcttctaatgaccaaactttaggggactaggactgtgcatctcagaattaaactggtatttctgatatgtatggtttatggttcaatggaaaaatataagaatttttcaaataattttctgattgtaaggatgaatgtgacctaatgttaaaatggcaggacagaaatattaaagaactgaatgatggcatcagctcagccatttagtatttgattttggacttagtttcctcatctgtataataagagctttgcctatgtatttttccaagaccatttcagggttttgcattattttatttcatttggaattaacattcaggtcatcttatagtagtgtactgaataactgaatgttaaatgtcttgctaaaataaatattgggttggtgaagttgaagttttggaataatagctaaaattaataactatagattttaattaatgatttcattcactaactttcaaaagttagacattcaaaaactgcaagaagaatattttttcaagattataaattgctagattcttcctgcagtggaaaggggaacatgagatatttgcagtattaaatagatactcactttcaattgatacatttaataacatcactaaccttcctattcatagtgaaatgagtgatgaaaaagttttttagtaaatattttttactggaacagaaataattttgtagcaggattcataatttgtgtatactgatttaagaatatcattacttcctgaaagtggcattcatctctatgggtagtcattttaacaaggtttttgttaaaaccttccccttcattaacacactttaggaaagtgtcttctaagtcattctatcaaagtctgttgctttcaaatttgattaaagaaaacaaagtattatttgcgtacctcatttttctctaacacatttttctttgcatttctcatattctggattatgtggggatcaaatatgatttaaatgttatgcacaattttgtggtttttcctactaatgaaattttgagttgcaaagttaacattctgccattgttaatatattcttattataaaaagacaaaatttcaacacatttcatttaaagatctcaattggcttttacttgcaattccagaatcgggcagccattagaaccaaaacagttctgaggagctcccaggctgcaatgtggtgcgaaatgttttatggacagaaaatggaaatgaggtgcagaaattggaggtgagattcagagatagctgattggttacagctcagcctttgccttgtttgaacatggtttgaacagttgattgactgaagctaggctgctgtgattggctgatactttactatttgttacaaaggcaaattcctaatttaagctttcaaattgtttaagtactaagttaggttttactttgttacttaggactcatatcgaggtttctaaagcccacatctgatacgatttaacattacctatgtgaagaattactaagcagaaacattttgaaagcctcatgacctgaatcgtattaaatacttaacaattgaatttgtctcaataataattatgtttaaaattatgaatgctggtttgtaaaaaaaaaagccacaaattttaaaattctgatataatctaatatctggtattcagctttgtattatcattttaaaatttaatgaacatctctggactctaaatatttttctttttaaagttatataaaacattctctttatattcattataactattaaactatttgcctacttatttatattgaaagtccttaatatttttacaataatttaataggtttcacaatcatcattacttattatagtttatactgtttgaataataaatatatgtctatactatgactcattgatacatttcaaaatacagtgcacataagaagatcttcattctctagatctgtcatactacatatgtgaaagttaacatttgtagtggcagtgaatcctaggggcagccttgcatgttaatgttatgtggttgatttgagaggatggggatctgtgtaatcatatgatgacaatttgggtttgggaatctcagaaatgccatcagtataggaatatggctattctgctcttcctaggctaagaataaacttgaagacaaagagtagattttggccagacactgatgctaaagtcaccccgatgctgtctttgcttctaaggtataaattaccttattttaagcaactttttcaccttttcaactctatccctttcctcagcctctttcatatgtgaaataaaatattcacttactactgaggatgattttttttaaacctattaaagaatactccatagctacagaggggaccatatcctttagagactccgttggggatgatcatatgcagaattattcttgtccctttgcctctgcttaatccccttcacaaagtctgtggctcaaacaaatgagagttggcagtactaaaggaataagttcccagcatacgtctgccatgctttagcatcatttcagattagaagcatggagcaaaggcagggagacgggtcaaacaaaatgctgagagcttccctccttttaaaaaacaaaattctagtcagggaattatttttaaataaaatgcaagcccccaagacataaataaacagccagcatataatactaacaactcaatgaaagatacttccccaggtcaactcatctggtaggatcagttattttgtgttactgcattgcccctctagcgggatcatagaagaccctaaaggctacaagaagaactgctttctggctctcaagtcatttcagtggttccctgatggcagctgtctctttggggaggtggtgccgtggtctgtttggggttaggccatcagcacaggccccttgtgctagcatcacattgtcataagctttctgctaccatggctaccatccatcaccaggctctgtctccatgggcagcagcctctgtgcccaggccaccccaggacctcaggcccatctctctttccaaaggtaggtaggtggccttttcccattctttagtttttgactttgtataactgaagcttctcctgggatgatgcaggcagctgctgcacagtcactccagacttactcttcactttgttgttaggcccctgcagctcgctgcacgtgactggtgccatctgccctccccgcacgggcagctgcccctcccacactgcctatttccccctttctgctttttgtagccacatgtctaaagatggcaggccagtctctgtggtctattttatgggactttcatttataactaggcagcaacccacattagttatttatcctgatgatctccctcctcttgccccccatgacaggccccagtgtgtgttgttcccctccctgtgtccatgtgttcttattgttcagctcctacttataagtgagaacgtgtggtatttggttttctgttcctgcattagtttgctgaggataatggcttccagctccatccatgtccctgcaaaggacatgatctcattccttttaatggctgcatagtattccatggtgtatatgtagcacattttctttatccagcctatcattgatgggcatttgggtggattccatgtctttgctatcgtgactagtgctgcagtgaacatacacgtgcatgtatctttgtaataaaatgatttatatcttggggggtagatacccagtaatgggattgctgggtcaaatgatatttctggttttagatatcacaacaccatcttccacaatgattgaactggtttacattcccaccaacattgtaaaagcattcctatttctccccaacttgccagcacctgtcatttcttgactttttaataatctccattctaattggcatgagatagtatctcattgtggttttgatttgcatttctctagtgatcagtgaggttgaacttttttcatatgtttgttagctgcatgaatgtcttcttttttttttcttttattttcttttttttgagacaaagtctcacagtgtcgttcaggctggagtggtgcagtggcaccatcttagctcaccgcaatctccaccttccagcttcaagcaattctcctgcctcagcctccgaagtagctgggattataggcacctgccactatgcccagatacttttttcgtatttttagtagagatggggtttcaccatattagctaggctgatctcaagctcctgacctcaggtgatccacctgcctcagcctcccaaagtgctggggttacaggcatgagctgcctcactcagccatgaatatcttcttttgagaagtgtctgttcatgtcctttgcccacaattgtattgttagtttttttcttgtgaatgtgtttaagttccttgtagattctgggtgttagacctttgtcagatggatagattgaaaaaattttctcccactgtgtaggttacctgttcactctaatgaaaatttcttttgctgtgcagaagctctttagtttaattagatctcatttttaaatttctgcttttgttgcaactgctgttggcaattttgtcatgaaatctttgtgcccatgtcctaaatggtattgcctagattttctagggtttttatagttttggggtttacatgtaagtctttattccatcttgagttaatttttgtgtaaggtgtaaggaaggggtacagtttcaattttctgcatatggctagccagttcttccagcaccatttattaagtagggtatcctttccccattgcttgtttttgtcaggtttgtcaaagatcagatggttgtggatgtgcagtctattttttttttttttttttttggagacagagtctcgctcttctgcccaggctggagtgcagtggcaggatcttggctcactgcaagctccacctcccgggtttacaccattctcctgcctcagcctcccgagtagatgggactacaggcacccaccaccatgcctggagatgtgcagtcttatttctgagttctctattctgttccattggtctatgtgtctgtttttgtactagtaccatgctgttttggttacagtagctttgtaatatagtttgaagttgtatagcatgatgcctccaggtttgctctttttgcttaggatagtcttggctgtatgagctcttttgtagttttatataaattttaaagtagtttcttctaattctatgaagaatgtcaattgtattttaatggaaatagtattgaatctataaattactttgggtgttatggctattttcacagtattgattcttcctatccatgattatggaatgtttttccatttgtttgtgtcctctcttttttccttgaacattggtttgtagttgtccttgaagaggtccttcacttcccttgttagctgtattcctagatattttattatctttatagcaattgtgaataggagttcatattcattatttggctctctgcttgttattgttggtgtatagaatgcttgtgacttttgcacattgattttgtgtcctgagactttgctgaagttgcctatcagcttaagaagcttttgagctgagacaatggagttttccagatatagggtcatgtcatctacagacaaagacaatttgacttcctttcttcctatttgaatatcacttatttctttctctttgcctgattgctctggccataactttgaatactatgttgaataggagtgttgagagatggcttccttgtcttgtgttggttttcaaggggaatgattccagcttttgcctattcagtatgatattggctgtaggtttgttataaatggctcttattattttgaggtatgttccttcaaaacctagtttattgagagtttttaacatgaagggatgttgaattttattgaaggccttttctgcttctattgaaataatcatgtggtttttgtcattggttctgtttatgtgatgaattatgtttattgatttgcatatgttgaacaagccttgcataccaacaattaagccaactttatcatggtggataagctttttgatgtactgctggattcagtttgccagtattttattgaaaatttttgcatcaatgttcatcagggttattggcctgaagttttctttttttgctgttatctcttccgggtttggtatcaggatgatgctgccctcatgaaatgagttagggaggagtccctctttcaattgtttggaatagtttcagaagaaagtgtatcagtttctctttgtacctctgatagaattcagctgtagaccagtctattcctgggcattatttggttggtaggctatttattactgcctcaatttcagagcttgttattggtctactcaagaattcaacttcttactggttcagtcttgggagggtgtatgtatccaggaatttatgcatttcttctagattttctagtttatttgcatagaggtgttaatagtatcctctgatggttgtttgtatttctgtggggtcagtggtgatatccctttatcatttttcattgtgtctatttgattttctctcttttcttctttattagtctagctagtggtctatttttaattttttttttcaaaaaaacagctcctggattcattgactatttttaaaggttttttgtgtctttattgccttcagttctgctctgagcttggttatttcttgtcttctgctagctttgtggtttgtttactcttggttctctagatcctttagttgtggtgttaggatgtcaatttgagatttttctagcttttcaatgtgggcatttagtggtatacatttccctcttaacactgctttagctgtgtcccagatattctgatatgttgtctgtttgttctcactcatttcaaagaacttcttgatttctgccttaatttcattatctacccaggtgtcattcaggagcaggttgttcaatttcgatgtagttgtgtggttttgagtgagtttcttgagttctgatttgattgtgctgtggtctaagagactgtttgttgttatttcagttcttttgcatttgctgaggagtgatttactttcaattatttgatcatttttagagtaagtgacatgtggcaccgagaagaatgtatattctgttgttttggggtggagagttctatcgatatctatcaagtccacttgatccagagctgagttcaagttctgattatctttgttaattttctgtcttgatgatctgcctaatattgacagtggggtgttaaagtatccccacaattattgtgtgggagtctaagtctctttgtatgtctcaacttgctatatgaatcagggtgctcctgtattgggtgcataaatatttaggatagttaacttttcttgttgtccccttcaccattatgtaatgcctgcccttatttgtcttttttgatctttgttggtttaaagtctgttttgtcagaaactaggatttcaacccctgcttttttctgttttccacttgcttggtaaattttcctccatccctttattttgggtctctgtgcagctttacatgtgagatgggtctctttaatacagcacactgatgaatcttgactctttatccagctttccattcttttagttggggcatttagcccatttacatttaagggtaatattgttatgtgtgaatttgatcctgtcattatgatgctagctggttatttgcagacttttttgatgaagttgcttcatagtgtcattagtctgtgtactccactgtgtttttatagtggctggtaacaggttttcacttccatatttagtgcttccttcaggaactcttgcaaggcaggcctggtggtgacaaactccctcagcatttgcttatctgaaaaggattttatttctcctttacttatgaagcttagtttgaccagatatgacattgtaggttggaaattcttttcttcaagaatgttgactattgccccaatctcttctggctttttgggtttctgctgagaggtctgctgttagtctgatgggcttttcttcataagtgacctggcctttttctctggctacctttgacgtatttttcttcattttgacattgaagaatctaatgactatgtgtcttggggttgttcttctcatggagtatcttactggggttctctggatttcctgagtttaaatgttgccctttcttgctaggttggggaagttctcctgggtgataccctaaagtatattttccaacttgattctgttcttcctgtttctttcaggtaccccagtcagcggtaggttcagtcttttaacataatcccatagttcacagaggttttgttcattccttttcattcttttttctctaatcttggctgcctgctttatttcggcaagatagtcttcaagctctgatatcctttttttccacttggtctattcagttattgatactcgtggttgcattgtgaagttctcatgttatgttttttcagctccatcaggtcatttctgtcctctctgagctggtgattttggttaacagctcctgtaatattttatcatggttcttagcttctttgcaatggattaggacatacttctttagctcagtgaagtttgttattacccatcttctgaagcctacttctgtcaattcatccatctcagcctcagctcagttcagggcccttactggagatatgttatgatcatttgaaggagaagaggcactctggctttttgagttttcaatgtttttgcattgattctttctcatctgcatgggtttatttacctttgatctttgaggctgctgacctttggatgaggtttttatgggttctttttaattgatattgttgtcctggctttctgtttgtttttcttttagcagtcaggaccttcttacatagggctgcagccatttgctgggggtccacttcagaccctattcacctggggtcctcccacacctggaggaatcaccagtggaggctgcacaacagcaaagatggcagagtgctccttttccccaagaggagcaccaacctgatgctggccagagtgctcctgtatgaggtgtatggagacccctgttgggaagtctcaccgactcaggaggaacaggatcagggacccgcttaaataaacagcctggcttcctcttggcggagagggtgtcctgcactcaggagaatccgcctcatcagggctgccctgactctccagagctggcaggcagaaaagagtaagattgttgattcacgataccgcagccgcccctcctcctatgggctcctttcagggagatcagagttctgttcataaacccctggctagggatgctgaaaatcccacagggaggccccacgcaggtaggaggaatgggtcaaggttctgcttaaagaagcagtctggccaggaactgtccacagctgctgtgctgcgctgtggggaattgctcccgttccaaactgcccagtctcgctggcacctgcagcagggaaaaacggctgactggagcagcagtggtggtagccaccccttcccccaccgaactcggtcttcttaggctgtctccaacctgctacactggctgacagggattccaaagtgggtttcagtttgtagggttccaagggagcagggccgctgagcaaggccgcttggctccctagcttcagcccccttcccacaggagtggacggatctcctgcctccttagttttcccagagctagagtatgcaaaaactcttatgtctcagtgtctgcccaagtggtcgcccacctgagcagccgctgtgagcctgcacagctctgtgttttggacccaaggcccttggtggtgtgggctcacaagggcgtgggttgcagagatccatgggaaaagcgtgcttttcagagctgggtagcacaatacctcaccagcttcctcggctcagagagggagcaccttttgccgcacgcaggctccgggtgggccctcgctccaccctgcttttcctcactgtctgtgggttgcgccaaccatctagtcagtcccaattagagaacctgggtacctcaattgaagatgcagaatttacttgctctttttgttcttggtggaagctgcagactggagctgtttctatttggccatcttggctcaaggttcagtttgagtttctgttgcagacactgcaagaaacagaaccgaatgaacaagagatatgaaagtatgtatcatggcaataactgtttctgtttatttcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaaaaaggaaaaaaaaatcacatctaaaaatgttcaatgtcattacattgaacactgaccggacaagtaagctggaactgtatggttatattcacaaattctgggatgtttgttttggctttgtgttataattgcagctacgaaactaaaagtgaacaaattgctttctcatttaatttctttttatcatgtctaagtctcagtatttttatttgtagaattgtgttaataataatccacaggcttactatgaggaataaatcagatactgtacataaaacaaataggatatttgttgacatatagtattcattcaccagatgcttaatctttccttcctcttgtctatgttagcctgcgattgttattctagtgttggtctcaaataacttaaactgtcattagaattttgctttaattcatagggccaatagaggaggaggcaatggaaaaatcactaggtatgtttgcttagtctctcagatgctatagcacacaactctcagagacttggaaaaatggaaacacagagatgttgttttgtgttttgtttttgagcacagttcttatagtaaatgtgaatgtttactattatttctagggtttatgataaaagatggaaaagagaggctatactgatgaacgttgtcaacatgggggcttgtcagaaattaaacaaacttttaagaaagtaattgaatttaacaaacattattgagtaccttatctggcccaggcatggatcttaacctcaactcctcatcaagggtagaaagtagactcagtcaatgctaggcatggtggttcatgcctgttattccagtgcttttggaagccaaggcaggacgatcgcttgagaccaggagttcgagaccagcctgggccataaaccaagaccttatcgctacaaaatagaaaaaaaaaaaattagccggaaatggtggtgtgtgaatgtagtccaagctacttggggctgaggtgggaggattgcttgaaccgaagagtttgagcctgcagtgagccattatcacaccactgcactccagcctaggtgacagagccagatcctgtctcaaaaccagaaaacaacaaaacaaacagacaaaaaacagactctttctagtcatgactttattccagtgcttaccacctggtccttgccctcagagttcacaataaagggattctggtctgggaagaaagcaactttaaagaatttctatcatcattctcataataccaataaactccaaaaaagagcctaaagattttcaaatgaccttccttagaagttctagatcctagttgattacctgagcaaccatttgcctatgtgtatttcaatttaaattgtcataaacagctactcaaggaattgattaatctgaattcaaaaataacttttatttagtgaaagtcaaagcacattattgtgttttaaaaagtcaaatgttgccaactcatgacttagttaagcctggaatatgaatgtgcaattgaagcagacattggctgtatgcacaatgcctgctgtttttcttgctgttagtcattatatgttatgtcctttgtcaggttggaaacaaaagattaatttcatttggtaggcttttaaaaatgtgtttgtctggttgtgtgtgtgtgtgtatatgtatatatgcatatatacacatatatacacgtatgtatgtatatatatgtatgtatatatgtatatatgtatatacacacacacatatataaatttagttctgaaatttaggcatatatatatatatatatatatatatgaaatttaggcgcatatatatatatatatatgcgcctaaatttcagcactaaatattaaagtttaggcttaaagtaccaagatatttttttcagagatggattattttagcactaaaattcttctgagccttcagtattgctgagctttatttaggaaatactcagtgatagaagatgaatgcaaaaaaaattgattaaaaaccggagccttaaaaattgaattcccttcttactgttgatgttcttatattattttggtatctacataaatgattatttgaaaaaatttctgacatctgatgatgtgtaacatgccaaattaatttccgaatgttaaaaatcattttacttatggataacttcattatgtagaagctgactatctaatttgtaattatttttatagaaaaatggcaagtagaagcttatcatgggtgaagttaacaacaaaaggctaaaatttatttgtctctcttcagtctttttctcttcagtcaaagacaacttacacacaacaagatttctccttcttaattactacatttattatggtatttaccctgttcaaaaagccttagtgaggttccagctttgaataagatagagtaaacatactgtgccctgtctgtcctactgaatacaactatcaaacctggacaaaacacatgaattatattttcaaggactctgaaaagtgaattgtagcagacggactgagaaagaccagacctgaaaataaaacaaaaccaggcgtgagtttaccatgtttatcctctggaggaacccagctttgacttgggaagctcagaagtagacatcaacacaggcaggaagagcttcacctggcagtgacggtgacagcagctgagggtccccaggtttctaaagctctcaggacgagaaagtaggtcccaagataaggagcctaaagggcttttttctttctgtgtattccttcttggcctccaacatgggtacagtcacaagagcatgtaacagagaagaaggaatagacctaccattttctagataaagaattggaaagaggatccacaggtaaccaaaaagtaccagggaaatggcagagaaggaaaacctcaggagaccaacctcataagtggtatttattagtgcctgggctcaaatccaaattgtacatgaatatgtctggtcctagatagggtaccgaagactttgaaagtgaattttggtatatcattgcccagattccagactggctattgtgtgacacaacatacaggatatatctgaatagtgctcagaagagtttgaaaatgcaaatgatattaaaataaagatgaaaaagagaaagctggtcagaacttgtggacataacccttctggatctgttgcctgattaaaaaatagttgatattctcgaatgaattaaaacaagatttagagactgagcatggtagctcattcttgtaatccaagcactttgggagggcaaggcaagagaattgcttgcggccaggagtttgagaccagcttggccaacagtgagaccaggttgctaggaaaaagaaaaaataaaaaaataaaaagctgggcatagtggcatgtgcctgtagtcacagctacttgggaggcttaggcaggaggattacttgagctgaggatgtcgaggctgcagtgagcacatcactgcactccagcttgggtgatagagcaagacctaaaaattaaaaaaaacaaaaaacaagacttagagtctcataatattcagtaagtctagcatataatgaaaaattgctcagcatatgaagaactaggaaaatttcaacttgcatgggaaatccaacctacattaacactgagatgacagatcttggaattacctgactgactctaaagcagctgttattaaaatgttccaatgagtaagggcaaatctctttatatgaattgaaaggaagaaggtctcaacaaagaaataaaagaaatacagacattttatggtaactttagaactaaaaaacacaataactcaattaaaaaaaaactcattggaaggctccatgaaagtgacagaggaagaattggtgaatttgaagatagattgatagaaattatttcatatgaacaacacagagaaacatgatttcaaaaaaaatgaacatagcttcaggaagctgaaggacaacataaaaaggtctgatatgtatggctttgaaaatccagaaaggtagaaagagtgcagtgtgtgtgtgtgtgtgtgtgtgtgtgtatgaacatgtacacaaacgtatataaacacccttatgtttgaagaaataatggctgaaacatcccaaattagccaaatcacataaacctacagattcaaggacctcagaaaactcaaaataaacacaaataaatccatgcccaaagacatcataatgaaactgctgaaaactaaagacaaagagaaaccttgaaaaaagcctgaaaaaaaatgatatgttccttgtggagaaaaatctatttaaataacttcaaatttcttgtcaaatttcacagaagctaaaaagaaatcaaccaacattttttaaatgctggaggaaaagaactgtcaagtaaaaatattatatccaacaaaaacctcctcaggaattaaggcaaaataaagacattctcagattaaaaacaaaataagacaaaacaaaacaaaacaaaaacccaaagataccctctaaaaagtttgctgaagaaattcttcacacacaagaaaataaactgaagagcaagtttcatgaaagaacagcagaaatggtaactatataaataaatatagtacatatcatccttttcttgagttatttaaaacacttgagagtcaaaagcaaaaatatgacattggctgatacagtttttatccagtatgcatatttaatttaaatatctactataatataaaaggacctatatgatggtagtaggattcctgcattctacttgaaaaagtaaagtattgattctaaatataacatgaaaattaagcatgtatatagcaatccctggagcaaccaccaaaatttttttttgtatacacaaagagatacagtaaaaaacctgatatacttcggtggaatgctaaaaataatccaataacacaaaataagacagaaaagctaaaacagaggaataaaaatcagaaacaaccagcagaaaacaaataatgaaatggtagacttaaatccaagcatatctatacttgcattaaatgtaaatggtctaaagggccaatttaaaggctaatgattaccagaataaataaagaaaaatgtatgatgcagcaatatgctatgtacaaaaaatcactttaaaataatgacaaaggtatgcccaaagtaaaaaggtgggaactataaaccatgcaaacattaaataaaacaatactcaggttgctatatcaatattagacaaaatagacttcaaagcaaggaaaatgactgggaataaagatgacattaaataataataaaaagaacaatttactaagaagacataacaaccttaactatgtctgtagcaaacagcatagcatcaaaatacgtgaagtagaaactaacaaaaatgaaaggacaaacagaaatattcacaattatactttgaagattcaacagtactttctagaaaattgacagaactagtaaacagaaaatatgccttgatatagaaaagctgaaggaaaaaaccaactgactgaatatagttgatgtttttctcactctactccaaaacaatagaataggcattcttttcaagtgcacgtggaataatattacatttatgaagatagacctcattctaaataataaaacaaatttatggcaagttcatggaattgaagtcacacaaaatatgttttttgtccatagtgtaattaaattagaaataaatgacagatgccaggggaaaaaaattccgaacagtttgaaattcaacaatacacttctaaatactctacagtcaaagaagaagtgtcaaaaaaaaataaattatttcaaactgcatagaaatgaaagtacagcatatcaaatttgtggaatgtctgcaaagcaatgtttggaataaaatttattatgtaaaatgctcatgttatgagaaaataagttctcaaatcaataatataagcagccaccttaagaacttacataaagaaaagcaaaaaaaaaaaaaaaaaacacacacacacaaagcaatcagaagtaaaaataataaagagcatacatcaataaaactgaaatcagaaaaacagtagaacaaattaatgaaaccaacaggtggttcttgaaagagattaatcaaattgatgaacctcttgcaagactgacaggaacaaagataaaacacacaatatcagaaatggaagaatcaccactactgacaccatagcattaaaagcataagaaggttatgtgtttatttatgtataatagcaataaataattagcaagcacaacttaattagtaatttcacttaaaatagctttcagaatgtgaagcacttagacataaacctaacaaaacatgtacaagatatgtatgctaaaaactacaaaccctcatgaaaaaatcatagatgacctaaatgaatggagacatgtaccttgttcatggattaaaacactaaacttgttaagcatgttaattctactgagttgatctatagatttaatgcaactccagtcaaaatcacagtagaatattttgtagatatagacaagctagtgctaaaattcatatgaaaaggcaaaggaactagaacagccaaagcacttcttgaaagaaatggagaaattatgtgctcaattttaagaattattaaaaagcttcagtaatcaagagtctggtatcagagacgagatcagtgggtcccatagatcaatgggacataaatagacctgcataaatatgccaactcatctttaataaagatgcaaaagcaacttactgcagaaagggtaatgttctaacaaatagtaatggaacaataggaaacaattggtatacagaagaaaatgcaacctaatcctcacatattatgcaaaaagaagctcaaaatggatcgtagatttaaatgtaaaacacaaaattataaaatgtttagaagaaaatcttcatgacctagagttagggagtgagtttgggcatatctaagaagaaaatatatgtatatatttgataatttaaattggactttatacaaatttaaaacttttgctctgtaaaagacactataagagagtgaaaagataagctatagacagaaataaaatcttttcaaatttcatattcttcaaggggtttgcattcaagatatatttgaaaactcttaaaaatcaatggcaaaaatacaaagaacacgatttaaaagtgggcaaaagtcttgaacagattgtcgaccaaagtagatatggggaaggtaatcaaacagaactatgtgcaacatcattagcttaacttagggaaatgcaactaaaatgataatgccatagcactagaatgataattataaaaagaaaacaaaacgaaagaccctttcactaccaactgctggtaaggatgtggagcaactagacttcttatacgttgattatagggatacaaaatggcaaagctgcttgaaaaatgggttggcaatttctcagaaaggtgaacaaatgcttatcatatgacccatacatgccattccttagtatttatgctagcaaactttaaatttatgttcacaaaaaaccatatgtgaatatttatagtagctttgttcatatttgtcaaaaattgacaatcatcaaaatgccattcaacaggtgaatagaaaaacaaactgtggtatctgactacttcttgtcaattaaaaggaatgaattattgatttgtgcaacaacttggatgaatttcaaaggcattatacagaatgaaagaagtcaacctcaaaaagtttacctaccatatcatatagaatttcaacaaggcagagttatggtggaacgaaatcagtgagtgccaggggttggggtgggggaaaagtgtgactacaaggagatagcatgggaggttttgggggaactgatggagctgttccacatcttgattctcatggtgattatataaatctatgcatgtgatataattcataaaactatgatttatatgactataaattaattttaaaaataaaactagaagaaaaaagtcttcccaatgcttgactattgcttttagattatcctctaaactccatagcaggcaatgaatggcttccattctctggctacactcattttcccaacgtatttttttgcccagcattgttgtgaatctgttctcagtgtctcactcactttagtttttctctattccctaaagatccgagttataatatacaacctcaccaatgctgattatttgagaccagcagcatatctggagctggttaactgacagatgtgattggttggaactttacctaattcacccaaggcacatttggttttcaaagacttgaaaagggatcaatgttctcatctgtgaggttttaagacttttgtaggcgaggatgaatttcattctactgacaacctgaacgttttttcatgatttcaatacccctataaaaagataaaggcagctgggaatacttactctagaagaaatatggttgaaaggagaatataaaccattcacataaatggtaaataagtatttgtcatcttaactaaggatacaaaaaaaaggaagtgtgcatcaattataccatgatggattaattgtgctgtatggaaaaatttcctattaaggaaatttgtttaccttcctgaaaagtgtggctgaggttggtcacagagttgttctctagatctctttaaggatagattcctttttattttttaattgacaaaataaattttatttacttactgtgtacaacattgatgttttcaaatatatatacattatgaaatgactaaattttatcaaattaacatatgtattacattagatagttaccatttttgtggtgagaacactttacatttactcttttttttttaagaatacaatgtatcattaatgatagtcaccatggtacaataaatatctgtaatttattcctcctatctaactgaaattatgtatcctttaaccgacatcttcctaacacctccaatcagttcaatccaccattctgttctctcctatgagatcagcttttttagattctgagtatgagtgagatcatgcaatatttgtctttctgtgcctggattatttcacttaatacaatgtcctccaggctcatccatcttaattgcaaatgagaggatttccttctttattacagttgaatagtattttattttgtatatgtaacacatttcctttatccattcatccactgatggacactgaggttaatgtcatatcttgactattgtgaatggtgctgcagtaaacacggtaaacacggaagtgtaaaatatctctttgaaatacttatttcatatatatgtatgtatatatatgtatacatacatgtacatatatattcatacatatatgtatgtatatacatatgtacatgtatgtatgtatgaatatacatatatgcatgtatacatatatatgtatgaatatatatacatgtacatgaatatgaatatatgtacatgcatatgtacacatatatacatacatatatatatatatatatatatatatatatatatatatagtggtgggattgctggatcatatggtagttctgtttttaattttctgagaaaccttcacgctgttttccataatggttacactaatttccattcccaccagcaatgcacaagagtcccctttcctccacatcctcactagcacttgttatgttttgtctttttggtaaaagccattctaataggtgtgaggtgatatcgcattgtgacgttaatttgcgtttatccagtgattagtgatgttgagcatttttcatatgcccgatggccacttgtatgtctttttttgagaagtgtctattcagatattttgcccgttttttaatcgggttgttttgttgctgttgagttgtttgagttccttatatattttggatatgaaccccttatcaaatgtatattttacaaatatgttttcccataggatagatttttaaccgtttgggatggtttaagggaggccaaatggaaagcctaaaaaaagagcattctgtggctccatggtggattctggcatacttttttcaggatgctcttttccaggtcaatatttaaagaacttgaagaccgcaaagcttctgctcttgagatgagaaggagcttctcctccactaatgatctgaatttaacactggatcacttaaagccaggttcatttgcaaaatatttgctcagctttgatgctataaaagcctctccaaagctaaggaaaccctgagaaatggattattcatgtgactctgcagagcttggtatcaggcattgcttgtatttaatctttccctaagcattaacattctaagcttatgaaaaatttgtgacgtatgctaaatatattccatccagttatgatcagagtccagtcacctgagtgtaagatttctgccctttcagtgagaattgagagccctggtgaaggcagatagaaaagcccagaaacacttgttgttttatttatttttcattgagcctctggctaatttttgataaggtgtcacagatttaatcagttttagtttaaatagaagattgagaaatactatcttcttttcattaccattagaaagaaaccttaaagcttaattttgactgcatgaaatgatatctaacagcaaatatttgtaattggtgtattccagatacttgtagtgtaggaaatacaatattgttttctttaaaaggaaattgggtgtgtataaaacatcagaggaaacaaatttaaggcaagattctgaatgacagttctgtattctacaaacctttgctaatgaaagggaagatgatgattttcaatgtaggtcatggcctgaagtggagaatttctgaaattgtcattgcagaccctccaatcagcctgatctgtctctgcaacactcctgatgagctctgagccttctcagtgctatgagtatttacatcaggcagaggtgggttgggatccaaagcttacccaccctaatatgagtaagatgattctattacattcatcctagagagaatatccttcatagaaatagaggaagaaaaagcttgcatttggttaggaatatagattatgaagagcctccttatcctgaaagctgagataatatctgtatcatatgtggtaacaaaaaataaggttatttgtataaagaagttagcatataggaaggtatatagtaaagtgcttcataatggcaggaaggaaagaaatattgaaggaaaaatttaaaagacattgcgtcagttggtatctgtttttggcaagtaaacaaacaaaatatattttctcttttctgccagtagataggttaggaagcagctggaaggtaacatcgtgtctgacttctaggatatcacaccttcaatgagttattgttttattgttccttgggagcttccactgaacgtggtgttctgtcacttctgaaactctggggatttcttttcatgatagaaaattgacaactagtatttttttaatcatagaaggtaagaattgtgcttattgaccaaacatgtgatcaaaagtggttagaaagtctttagcaggtgtaccataaatgcctgccaccttcccatttccacacctccacagacagcttcttgtgaataccccctccacacatacccaaccatacatagtgttctctctgctaagaagaaaactgtatacagaccacatgacctcacctcactttcattctcctccgtacccaaagctgagactatggtggccagtcatttgtaagctgtctaggcacctttgacatggcattgtttgaaaagataagaggttatctttggggaatttggtatgaaggaacaaagcaatgagcagtgaagatgaaagtttatgtgacagaggctgagatagccatcatggggaatgatttaagctgaaattgtgggaaagtagaaagtatgactatgaataagtgtaatgtataacataaagacagatgatttataacacagagaaaatattacagatcagaaaatgaaaaagccaaaggggagagataagagagtggaatcgatttctgcgtaggtagagagtttaatataaagtagaatatggaatccttccatgttctccctcataaaattcacagaaacctcacgacttaccaaagatgccaagaggagcaggagatgctcttgtgtttcacccaaatatttgtttctcattttttttaatgaatgtgtgtattttctagaatgaatataaaggaatgcctcattcgtttatgtatttaaaatacgtcttgactaccaataatgtataacaacctctgctagactcaatgctaggtccagtgcatgcacttggaatccagggacccaacttggaagggctcacagtcttatgttaggagacagataaggaagcatatttatggggcacatgtgagattttgttacatgcatagaatgtgtagtgattaagtcagggtatttgagatgtccactactttgactatctgtcatttctatgtgttacatgctgtgatactgataaagacagggtatgtaaatgtgggagctcaaaggagggacatctaactccaacagtttgccagttgtggggaagaaagggtaaggaagtttcctcaaataattacatctgagcagaattatggcatgccagcaacctcagccaggtgaagggcaaagagaaacatttgcatgagagcctccagggaggtagagaatgcagtgttcaggaactacaacaacaacaacaacaacaaatcaagtattcctgggccacaagatgtgagagggggaatgatgggagatttgctggagggcagggggattcaaataaaagaccagcacacatgagctggtttgtgacctactacatagttttgacttgatccttacaacatagtattttaagttaaagagagagaagttcatatttgcagcggggaggtggataagtggttgttgagacattaaaatagtagagtttactggacttggaagacttagcactggacttggtaacttagtaccttgatttctggcatctcagtgagttgaggccacatgacaagtaggaggaagagcagttattatcaagagaatgcaaatgactgaaatgttgagttggggtttctatgggatatactggtagatagcagagtcagtagtaagatacaaataggtctgagacacaggagagaatctcaaaagggatattaagcttccatctctgtaagagccatatggttgggtagttggtttgctttgtgctatacaactatttgaagttctttacattttctttcctcctgttttttttttttttttttttttgaaacaagatcttgctctgttacccaggctggagtccagtggtgtgatcatagctcactgcagcctcaaactcctaggctcaagcgatcctcccacctcagccaactgagtagctgggactacaggcatgtgccaccatgccccattaattttttatttgtattttttttaaagacaggggtctcacggtgctggccagactggtctcaaactcctggcctcaagttatcctcccacctctacgttttcaaatctaaaaaaatagtttaggacgtattcaccttagagatttaagagtttatattttagcaagctgtaaagtccagaaatcaaattgtgagtgggcaaacaaaatcaaagcaagtttcatctcatttagaaatgtggaagaatgagaacccttagtttaccttgcttttgtgcatgcagagtgctagctgtaatgggttagcacaaaaagacaaaatcctaaatcacagtcactttgccataatttttaatagttatgttctctcatagttctatggatgacatgctcattatagacagtctgaaactgaggagaaccagggttcttcctacatgtttatgttgaatgtggagaaggtgaggttactgcttctgctgcccttttcagctcaacatttgatctggccaatgtggttagctatactgtgtctcctaccaccacacatactcagaaaactgtggtagtaaacatagaatgaacttccttaaaagtagaaaaccattcattggctaaggtacataagaataagaatgaatgatgaaaacattggtagaaatgctgatggaagaactgattgatgcagatctattttggagaccccttaactgccaggggacatgaattgcctggctggttgaattgactctagaaatgatgctctgtggccgctaagtctccatatttgaccaaaaggtgtgtgagggctgtgtccatttcatcacttgccatgagtcctcagggctagtcagaataccaggccgatacacgcttcacaagcatgtattgaatgagtgaatgagaaaatgaatacaataatattttcactagtagccatggattgaggataaaattaataagaagagcccccaggaagtccggattgagctttatgctctgggacactcttctgctcagctttgtggaataatttgcagcactagaaatggacttaacaaccaggatgagggggtcatgttttggggatcaaacctcttttcatcatgaaagctactgggtggcctctgacatgatgtgtttagttatcaaacatgtcagctaataccatggagagaacacatgtattaaaagtgacagacataacaagggtcaaagattaaaggtgaattgcaaagggctttttactgcatctctgttgttataacagtttctagagtaggttgaatacatgagcaaaaagaatgatgaggagtcatggtgagcagaagctctcttctcaggcaaagcaggaatttttttccccacattgagctaaatattctttaaatgctataaatgttactacatatctgtgctgtttgtgggacagcacaaacatatttgaaacattcagcagttctttctcattaacttccatttttctaattttcattggttatattttcctgattacagaagtagtattggctcattatcaaaaataaatgaatgaaaaaatatagacagttaaaatgtgatataatgtaatggcctaaatatgacattgttaactgtacattcctgcagttacaattgaagatggcattttatcccttaatcagatacaaagaactgttagaaaacttcctttttgcccaccactgcattgtatactgtggtatatatggaaattcccaatacagacatggaaatgataaataaacacaaggggaactctcacggcataactctgtgtctagcaggctaagataataccatgttgtgcagtggtggtaattagagcacatcacgtgactctgagtttttgagggcagtggtcaatatctttatctttgtatccccaagggtgttggctaaaatgttcagttagcactttgaatgagggaatgcttattgagtaaaaagtcaattacatgtgacaataaatgcagtaagaattagtcaagagaaagacaagtgtggcctgcagtcaccaacagaagctttaagctccaaggatacccaaatgcgtatgttaatcatgtgttattgttaaagcatttagatgatgatgtttggaagttgtgtgcaaaaccaggaaaaatttgaccaagttttggaagttcctttctgtttgatttatctgctgttatggtgttagggctattgctgttttatagatcagttctacactgtagtaattaactgggtaatgaagacaaaaagtatttagaaacactctgacatatcaagaaattagtgtcaccaacccagaggcttctctgtctcttcagcataatcttccatctcaggtatacctaaacttgggtgtttactgcctcaaaagcaagcatttcccttgaaaagcagatttctttctttctttttttttttttttttttttttttttttttttttttttttttgagatgagtctcgctctgtcacccaggctggagtgcagtggcacaatcttggctcactgcaacctctgcctcccgggttcaagcaattctcctgcctcaacctcccgagttgctgggtctacaggcatatgccaccatgcctggctaatttttttgtatttttagtagagacggggtttcagtatattggccaggctggtctcaaactcctgacctcaggtgatccgcctgccttggcctcccaaagtgctgggattacagagagaagctccagcttttgcactagctgaatgttgttatacttcctcaaacatttgaggataaagacataatatgtgatagttttaggtgactttttgtgtgtaacatttgagctctgaggataataatatatctttctatataacacatttcaatatctatttaatgtgccagttgcaagaattttctgattgacattgatcattttcattcagaattaagtcatttccttctgggaattaatataatagatttattatatgcttatgggccttgtctaagctctcttctccacactgtttcttcaaatgtaattccattgaaaatctagctgctgttttagagattacagtaaggcaaagcatttctcagaagacaaatatagaacctaaagttactataatgacatttggcaaattatataatctgagttcattttttttctcttctctccctcctcccttgtcacaaagcctataggaaggtatactacatattttgacacttttttttttttttgctttcaatagctgtgttcttactcaccactttaaaataacgtctttcttatatcttttaactcagaggtatactcagagactggaagacttgaacggggactggctacccagatagagcccccttggtggtgttttccttggtgatatgatactgggccgtattccctcaggattgcagggtgagaactgtgtctttgctagcagactaggtaggagaggatccattcctcagaatcaggttcatgttaacatagttcacatattgtattaaatacaaaccagaatgccaagttttttatttacaatgagcaatatagctgttaaataggctatggcactcaagtcaacaacaattcacagactcctctccccatagagaagcaacatggggatccaaattgtaatcagaatgccaagttatcaatttataatgagaaatgcatctgtctgacgagaatgttgagttggcctgataaattcattgtctccctgtagattagtgacaggggatgccaaattttcggaaagttgcgagagaatatggctttaaaacaatgggaaggagttgatcttaatttctgtcttccaattaagatggttttaacattcccacctctacctggctggccttgccgagaaaacaatactgctttagtcaaacaatactgctttagtcgctgtgaccagtgtgggcaataaaatgtttattttctgcctttcctttttctttgcttttctcaaccaactacctctctccaaaaatgtgtatgacataattgattgggcttttgtctgtcatagtattgattcatcgagcctcaatcatatttcagccttccagccctagaattactcccatattattttttactggtgtctgggctatgttcatatgtgccaatcaaacatgtatagtttactgacctaacctcacatttgtttaatcatatcctttatttttaaattctgtaaatcaactcactgcagtccttggcactgaaaatacctctatttcttcactacatttcctgaagtggcaaaaatgccaagattatatgagacccagggggaaatatagtgttctctgcccctagtgtttaatgcaaattgaaactaaaataaggcttgctttgaaaaagtacaaaaataaattttaaaaaatgctaaaagctggattcttctcttttggagatggcaaagagatagtaaagttgataaagagatgatttgggaaatgcaggtactttttagcattagtgagtagactcatttctaacatctcctggaagtatttgtgaattggctccagaatcttttgctatcacctaccctacaattaactagggatatgcaatcaccaaatacagtttctgggacaccttcaaagatgtcagcttcttcaccataaagatggcaaaaagtagaataattacattctatctttgacctttgatgagaaatgatcagtttctttttctaatccaatatggcaagcacttctaattcgtgtgaatagatctctttatagacatagtgtgtttatatttaaatactaagataatctggaattctgaagctacaactgtataatgacattatacttggtcagctattgcttttcttttcccatttatttattttgcattgagtcctacactggtgaaaggcctggtgcgttgcattgagttctgcatgtttgaacttcacaaaggttcaaaggtgtgcacatggcctggaacgataaacatttgtcctaaagtcattcttcagcttctgacatagcttgtgatttaattgccacctcattaatatgggccactgggtgtgaatttgtcaaaacaagatacatcaggagagctgagtgaaatgtttcatgttcagaggtttttaccactcctgttccccactgcccatgttttgtaaacttttaacttcaagagactggtttaataaacatgccctgtcttctaggtcattgggttaaggatcatttcagtctttttgaacttttcacttttcctgtgtaagtataagctaagtacttattgggttctaaagctaaaagcctatgaagataaagggccttattgaaatagtgaagtgagcaaaatatctttatggttcctgaccttgtcctcctgggctttgtccttcttttaatgaatgacaccttaccctcaggttcccagtatttacacctttgtagtgtttttgcaattcagaaaaatgtatttgatagatgagtagggtgactgtcgtttacaataatctattttctatctcaaaatagctaaaagagaatagtttgaatgtttctagcattaacaaaagacaaacatttaaggtgatacatattccaattataccgacttgatctttacaagttatacaaatgtattaattcaccacgtgtagcccaaaaatatgtacaactattaagtatcaatttaaatttttttaaaaggacacagtgaaggaccatacttaaacttgattatttaattgctcatcatgaaattttatagggaaagaagaagaaaatcttcaataactcaaactcataagtaaagggacatacatggctgtatataaaggctatttataaagccctctatataaaagttatacatagcctataaaataaataaggatctgactttatattggtacctggcacaacacatgcattgcacacaggaaccactccataattacaattaaaattattatacacacaaatacatatttacttcttatcaaggtatcacatgttaatgctcacatgaagcagtatcaaaataccgccaatgagttgtagaagtctcttgctctattttcctcagtggcattctcactccctagtgaagtgtttttaattatttttatttttttatttttttactggctattttagactttctggtagagcactcaataatttctggatctgtcagagttaggcaatccactctgcaattggcaagatggggattttgctcatttatacttgactctccttcttctattaatcttctccttctatttatataactgtaacatagctgcaagctttaagtaaaacacgtaaagtcattttcttgttctgatgacttgcaatattttctctttattccccacgagatgaaatgaggatcttggtcccatacgctttccccaacttcttctcactcatttcaggccctacttctgtcaatcactctttctgtgtttagattgttgatatttgcacgttctgctaaaaatacaatcatctttgcccaaaggttaactttaaaagtagaacaataaacagtattaacattattatggccacataaaaatcatttaatgttaggtaaaaagtatgttaggattacatttttttaagagaccaatgtcatgacctctaactcactgaaaagaaaagattcctagcatttgagttcaaataaatgtttttttccttatatttagtcaattgcttaaaattaagctgcatttcttttatgtattctattttcctgcatcatatcttcatatatatttttttactctctatcatattatctagtctatttggtctgctttcccccactccaaatatatcccccttctagagtcgtctttctccctactccacactggacttacaactcctagacatcgtgctgcatcgctaatgtcctaagtttggtgttattggtgctatcaatcttcttggttagatctgatattttggtagcttcctattttttgaattatcctcttgttttattataatacatcctaaagtaacttcctaagagaaagcacacaggaggtaaatgttctgtttcttgcatactctcatatttgtgtgaccctttggccgacgatagaattctaggttgaaaagagttttcctttcgaaatttgaaagctctgctccattgttgttgatgagaagtcaagtactagttttattcctcctgtttccctttaaaaacttttaggagcatctcattattttaggtatttacatgttttcgatgacatacttgagaatcctttttgcacttattacaatatacactcaaggaaacttcttggtttatagattaatgtcttccattgagctatgggaaactttatttctatcttttctttaatatgttctcgcctccattttctctcttctctttctctgacttttaatatctggatgttagatcttccagacttatcctttctcatgacttctgtctttatactttagtcaaattagtgagagtccctttactgtgtttactccctctacttttctattttgtttattccaacaactgtgtttttagtttctaagtagtctttcttgctctctattttaattgtccttaccttctgtttttattttttggttataatagtttctccaatttgtgtaagtttattagagtatcttttgtctttgttcatttatttcttacactattcctgttttcatcttgcctgtcttagtctttatccataatattgccagatctcctaatatatttattattcttgctggtctatttgtatttaagggaaacaaaaatggcagactgcttttttttttatctaatagaactatttacacttaaaatctttatccttagtgagaactgtgggaatagaggaaacagagggaggggcaggtgatccaatatattaaagaggtgaaatttggcatcaatgagcctccaccataaaagaatgtgaaaattgctattcccagatgccaacatctaactaaagccttgcttttctactgggaattagttcaatttttttagagaagaacaaacaataatttttgttttgctttgttttggtttttggtttggggggttgcatgattattattttcttggatgattattattatttgcttgtaattgttcctgctgtttgtttcccaatatctcaaacggagatatttggctgcacaggagaacaacatatgtagctgtttcatacatggagcttacattgggttttgttttcagtcatatcttttatttctacccttggactccctgaagtttttgttattctttttatttctgccaaatctcccaccaatttcgtagtcaccttatagcatattttagactctggttttctgcctgttacgttttaaaatggagcagtaaacacaattatgaccacataactaagttaaaattgagtcaaaaagtgtgctaagattaggttttagatttttttttactttcagggaccaatgttgtgaacttcccatcacctatcttcatcttcatcccaaaatagcacaccctttcttggttattatgtacttcttttgtgttctgctaaactattatatactatacttatgctttcaaaataattcatttatatataattaagttttgtgtaaatatttaacatataaatatttagtagaatctctgaaaggagtgaaggcaaaaactttcctgacccataataattacatacctagagcatcacaaaatctattatcaatgaatggattctgaattctttgataacatgtctttaatttttaggatttaaagtacctcctttaaagcaccagaccagtagtcaattattatgatactcacctctgatattgtcttatccctgagtgtgtaataaacttctggtccctggaatttctcttccctcataaaactgtttctcaatgtatcattttgtgatgacttttttttctgagcttcctttacctacccaataggtacacattttttcccaagatgctacaacaataccagacaattccagatattcccgccttccacttgtgatctgtaaaatatatatactggttggttatgtgcaatgttttatgccctatgccctttcactggtgatgttttaaagcaagcattgtagatgaccatgaattatagcagacaggttcccagtcctatgctgtttcctaatgtacattttttctcttgtcacaactaggaaagtcacgtttcagtgttttggttttggtgaatgcccacaacaaggctagtgaaggaaggaggcatagtaggaagctgttggccagacgagcttttagaagacccttgctacatagagaggacgtagaaaatgtctttatcattaggtgagaaacatgaactgcattctttgttgcgtcatattaaaatgtaaatcacaagaataaattataaaaataaaacctaaccaaaacacaaacaggaggaggtaacagaggacagaacagagttcctagaaaattatattacaggacagacatacaagtacccaagagaaagcaaaattctaaaagtctcttagccaagtgtagagcacaaaagttctcctcagttcatgcactttcgaggcatgtcagttggaaaaagagcatgctataggagacagttttattgtgttttgtgcagtgaccttttaaaagggaaaggtcctttctgagatattttgagttcactcatgcatctgtcatagaatttgcttggaacgaagtgtgcctgtcaccccaacctttcttcagagcagagcctgcttcctcatgggaagaatgatgttttaagagtgtcattcagatggaacagaaagaggtcttctccaggtttgtcttgctactgaatcaataggatctcctggattttgaaaagtatattaaattttttttcagacgtcagagttggggggaactagttttgtttagctttatacaaatttctagcattacttgtacggatatgctggagattctgctgcctcttgcaatctgacagcctcatggagagttgaataaatggtcattgcctgggtaagtgagggctctttctaaagtgttcaagagtaggtcacatagagaggagtgccttcttcctgcattttttcaagtacctgttttcccctattttattcttttggaagggattgattttatggtagtccctttcttttctcacctcttgacagaatgtttttctaaatgattccttcagattattctttaggtcccattaaaagaaacatgctggttcttcattctcattctgtctttatgcttaatgcagatataattcatatttgttttatcaaagtcatttgataacctcttcaatgacaaatccctgattacagatgtattctcttttggtaacccacaggggttgaaattgctctaatttttggtactgtgtattaggttgagattaaaaaaaactttgaggacaatcttttccttatttaatatctggagaaaaaatactacatgtgagaaaggtggaaaaaggatgttgcactgtatgtaataaaagctatgaattttggcacttttgtaaactgtaaagatgtaaatgttccttaattattttcagtagtcagacttatgtttcttccagttgtatttccaggctgagacaatacaaaagatggacagctctaagttgattatcaagctttaaatatgtttcacttgattaagaacattgaaggtgagaatggaattatgtaggcttcactgagtatccgtaaagttgggaacaatgatatacaacacagaaaagaagctccataagaaaacagctgcaactaacccatctggaaagagacctcaatcaaaatgatacttagcgaaagaaaaatactttcagtgatcaaattatttgtctgaccaatgcttggtggaaagattccacattactagttatttgtaatgggtaattgcacaatatactgtattgttcaatctggtgtgaatgaaagtggggagatcttgacaattgtcttggaacaatagatgtaaaattgagactattctgggaaaaccaggatgtttgggccccctggtaatagtctaatcattatacatctgtgctataagcacacaaataacatctagtaatgaaagaaacattcagctaagaaaacttgcagtcaaaaacttttgataaagctgtgaagacttgttaggtcatgtattaatttaagatctttaagatggagagcatcccatcaatgattaggagaaacacaaacattttatattgtgtttaatacacttttttatgtttaataaaaaacatatcacctaccctacaactcataattaacttatataaagttttttttgtttaataaacatttcatattgtgtttaataaaacgcaaacattttattacttacaggtcctgggtgggggcagtacgtggcatgcctggagatgacacacaaggagatcaggaagtgtgggcagggagaatgtggacctgggtcacttgtatttattggagtccagggtgagaaacctaagtgtcatgggacgaggggagcaattgggcagtttaaaacaagcaggcacaaaatttcaaacaacccaacattaaaaaccctttctggcaaagaaatgttatctagaaatctagctgacccaaaggctgagtgtgtgggtttggggtaagagctatcttgcctcaccagagcaacaaaaaggagaagtcatcggctaagctagatagccaaacaaaatggatgctgaggcaacattaaattataagaattataaggtcaagatgggatggagattctggacctggtacaaggaagtgctgcaatgaatagcagggagttagggcagactacttccagtgtcctgagttttcaggtttcatttggctgtcaaaaccatttgttccctagactgtgatttgactggtgatgctggctggcagtgcccctactgatgacttagcagatgactctgagctgacaatttgccatccttcagctgtcttggtaggagggattcagttaccagcatgcacagcacagagcagaatccaacctcatagattttcaaaaacttatcgctaaagtctattattaacagcttggtaagaaaagtctttttcattgagaaatgtatagattattgtgaaggaaaagtatttgctaagaccagactggccgaagctaatccttttgggaatagccttaccaatttgggggaaatgactcatttacttataagctatacctgtcagcttccctttactacctttgacagctcttaaaccagcagtataagaactgctagtgaaaaaataaacattagtataaaactttatgtacctattacataacagtcatatattaggtgtccattttaagtacagatactgaaatagcaaaataatttattggagaaactcaaaatgctatagaaaaatttgacttggaaagcaccacaaatgtacatgatacaagtaaacttgaagaaaccaattacattgggggatagtcttgttttctgttattctgtggacttgctttattaatatatggaatttagagtttcttatatttaaaaaatatgaaaatgcacataatcattcccaggctgctcctgatcctttagtgatgattcctacagaaaaaaaaaaagtgcttgggatggggaagaactttgtggccatcgattttttctttctttctttattatttttatttttttattatactttaagttttagggtacatgtgcacaacgtgcaggtttgttacatatgtatacatgtgccatgttggtgtgctgcacccattaactcatcatttaacattaggtatatctcctaatgctatcccttccccctcccaccaccccacaacaggccccagtgtgtgatgttccgcttcccgtgtccatgtgttctcattgttcaattcccacctatgagtgagaacatgtggtgtttggttttttgtccttgtgatagtttgctgagaatgatggtttccagcttcatccatatccctacaaaggacatggctgcatagtattccatggtgtatatatgccacattttcttaatccagtctatcattgttggacatttggcttggttccaagtctttgctattgtgaatagtgccactataaacatacctgtgcatgggtctttatagcagcatgatttataatcctttgggtatatacccagtaatgggattgctgggtcaaatggtatttctagttctagatccctgaggaatcgccaccctgacttccacaatggttgaactagtttacagtcccaccaacagtgcaaaagtgttcctatttctccacatcctctctggcacctgttgtttactgactttttaatgatcaccattctaattggtgtgagacggtatctcattgtggttttgatttgcatttctctgatggccagtgatgatgagcattttttcatgtttcttttggccgcataaatgtcttcttttgagaagtgtctgttcctatcctttgcccactttttgatggggttgtttgtttttttcttgtaaatttgtttgagttcattgtagattctggatattatccctttgtcagatgaatagattgcaaaaattttctcccattctgtaggttgcctgttcattctgatggtagtttcttttgctgtgcagaagctctttagtttaattagatcccatttgtcaattttggcctttgttgccattgcttctggtgttttagacatgaagtccttgtccatgcctatgtcctgaatggtattgcctaggttttcttctagggttttaatggttttaggtctaacatttaagtctttaatccatgttgaattaatttttgtataagatgtaaggaagggatccagtttcagctttttacatatggctagccagttttcccagcaccatttattaaatagggaatcctttccccattttcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcatgatgcctccagctttgttcttctggcttagtgttgacttggcaatgaggactcttttttggttccataggaactttaaagtagttttttccaattctatgaagaaaggcattggtagcttgatggggatggcattgaatctgtaaattaccttgggcagtatggccattttcatgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttatgggtggataagaatgcttgtgatttttgctcatcgattttgtatcctgagactttgctgaagttgcctattagcttaaggagagtttgggctgagacgatggggttttctaaatatacaatcatatcatctccaaacagggacaatttgacttcctcttttcctaattgaataccctttatttccttctcctgtctgattgccctggccagaacttccaacactatgttgaataggagtggtgagagagggcatccctgtcttgtgccagttttcaaagggaatgcttccagtttttgcccattcagtatgatattggccgtggatttgtcatagacagcgcttattattttgaggtacgtcccatcaatacctaatttattgagagtttttagcatgaagcgttgttgaagtttgtcaaaggccttttctgcatctactgagataatcatgtggtttttgtctttggttctgtttatatgctggattacatttattgatttttgtatgttgaaccagccttgcatcccagggatgaagcccacttgatcacggtggataagctttttgatgtgctactggatttggtttgccagtattttatggccgtcaatttttgaccctgagagtgaacctcacctttggaagttactaccaagcatttgacttttggaagactctttacacagcaagagatctcctccacctttgaggtgaggacattaaacttggtttaaaaaattacttttccaagtacattaactatgtcttatatattatccatacacgattactaagaaaatataaacattttttcatatactggttaattggctttaaagaaaaaaatcccctttttaatcccatcaggatttagtttgacaaatttttcagaaacttataaagatgaaaacacctggatgtatttctctgtaaactttggctgttagcatcctttttcaatgcttgtgtagtttttcagaacagaacctaaccttcaagatgagtcatttgttcccaaacttgaattgtcatgaaacactccttgggtttccctcccgtgctgaatatgatttctaagaatgggatggcatggttactgtataaagatcatttgttctacaggtcagaaggcctgagttctcatcattaattaactttgtgatgtatgttgggtaaatcacttaacctctacagttttatcttctgtaaaatatgaaagaaagactttgagctaaagtttgtttctactgtaagaacatgagatattttatcttggtgacatcatggcttatgggcaggctgaggtgggattagtaattgcaaaagcagtggtcataaggtgaagaaacctggacatgacttcagacttaacctgggaaataaaatcagggaatgtggacaaagtcagacactactttagcacaggatgagatgccagaagatgatggatccaacaaagacatgcatgaaaggccacggggctgtttctgggcttaaacaagctagtcttaattaggagaaaaagcggagggactggaggagtggaggagaggaagtcaatagtgatgcagtacttccatcctagagggtttcttcgagagccaagagttccaatctgtgcatggcattaccccttctgaggtaaaagaaaaagtcctctacaaaaacctgacagtattctgccctcaagccccttgttaaccaggccaaggtgaggcatgggtttcatgccctactgatagcagtgcaagatgtcttgttatgagtattgatatcgaagtatgcttttaaatcatatttcactctgacaccgttagctacgtaactaagtcttagtgctattgccagtggtccaatctaaatgatgtagtagagaatctagttcattactctgagctgggactctgatgaagatgtagggtgacacactgtctttgtgaagaaggcatgtgtggaatacttggtgtctttggtgagatggcagaacttaaaccgtgaggaggatggcaatcatgaggaatggtatcaggaagtttttccagcttgatagatgggaaggaaagcagaatggcaggaagggggccaggtgctatctccttgaaggagggatgaaccgtcctcagggtctgtctgctcacaggcaggagacttataccagaactgtgtttactggaagtcttttagagttcaaagtgaacttatctgagtttgacaaataatcccctacagcaagacaaagagtagtagatgaattatacatttggatactgttggaaagggagaggtaaaatccaagttggaataaagcatatgttatgggagatcatcaatatcattgagcacgggctttgaggattagagttatgatgaagtataatagtacagaatcagcttgagacacagtcttatgtttgttttggtcatctgcctagaagtaaggtgcagaaaatgcttatactttgaaaagtcgtgaattaaatagaactttctagcaatggttgatgaactgggtgggtgtcaaaaatcaagacttcatgattgggaagctgtggggatggggaattttcttagaaaagagagagactctaaatggtgctagtggggtggcctaagccctgacagtggaatgggacctttttggaagactgcacctcggggtaaggatgcttgtgaccctgagactagcatcaacccatgatagaacccaagggtgcagaaacctatgatagaaagcaagggtaccaaaaccttgagggtgttggcagactgaggggcactcagttcacccagggacatccttcacctgagaatgacttttctagatctccctgcagtggttttgagaacctgagtcctagttgagccttctgtgatgccttccaagtcctagcagtgtggcgtgcccacacatctttctcaacaaaggatgcagaaataggaatgtaattagagcagttcatcctcggtagagagtcctttgtggttcccagctgggcagtagtttaaaggatagccctgtgaatctactcaaatagtatctttatttaagatgtcaataaaaggtagtaaacttgagaatctctgagaagcattgatccatagtggaaattacatgtatttaagtatgaaggtagtaaatatatattaacaacacattatatgccagatactgtcctgggtatgagctatagctggaagtcagagcggtacaaaatctaccatgggggagtttaagaccaagttttcaagccaaacggaactggattctactaatttccagactgatgccttggagaggttacttgaatttttctgaatgtccattttctcatatattaaatgaccattataaccttgctctgtaagactgcttgttagatgatataatatctttcaaatatctgttaaagtgcctaataatagcataatagctactcaataagtagccataattgttttaacaaatgaaatttagactcctaggaaaattagaaagtactgcactggctttcctgttttcctaatggccatgattatttatccagtgactcagtgcagattttgatttattttccttttcatagccaccttatcaaaaagtcctgctactgttatttctacttcaaaatgcatctcaaatctattcacctctctctgttcccatctgtatcaccctagtccaagctctcttactccctagagcaatagccggtaaccatgtgcttacaacacattctctgcaaaggcagcagagtgtattttttacagcatatatcagaccataagggcctcttgcttataaaggaccagtggatttttattgcatttactatccaaatctgaagttgccatcataaccagacttctctcattctcttccatgtcttctggtatcacattcctgcactaacctctacaccctgcgtcctcccacctcacctcagcttcaccgtgttctcagtttccagcacgcaccaagctctgtgccacttcgaggcctcacacctgccgatctctctgcctatgattctcttctctatgctctttgctgaaccacctccttcttatccttctgccctcagccttacctcaaccagcccatcattctctcagcctccaccgtagcacttctcatgactggtgcttgcttatttacatgttttctcttgcgcattggccaccacaaaggtaaattcttatctgttgtgtgttcaccttggaatttcccatccttaactcgataggaggctcttattaaatatctttgtaaataaatgatatttttatgatagataattgcagattacatgattgttcagttgttaactctgtgcagtcgtagagtattctggttttaaagattagcacttggtttatatgtgaatgaactttcaaaattagacacgatcttctcagttttcttgtcaaagactgtttctaaagatttgcatgagctagtctggtcctggctatcttcctatcagggatgcattcctgtattggtagattctgtagattaactttctaaatcattcatggcccttccttctgcgccgttaactaggaagtataaagtactttagaacatttcattattagtattcccaatatgaccgtggaaatgtgggcagtgggatgaggcaatcaaactgaggttttctttcatgataactatttttgaaaactacctgcagtgagaaagaattctcaagcaggtgcagtggtgtttgagagaagcataaatggagtggttgagcccagaccttggagtcaaataaacctaggtttgcatctcagctctgttgcttacaagctatgtatttaaactctctgatctccaaagtggttttggtgattcaattagatcattcatacaatgagagtcttaacaaatggtaagcatttttaacttttagaaaaacacaaggcagttagtagacgaagtgtatgaggacattgctagcttaatataaggttctttaagggtaaaataaagagaaagggaagaaaggcagagttctttcttttttaacttcttaaaccttttcttatgaaaagatatgccacataaccataattcatcctggcaattaggtaaacagtatacagaatatgactctcgccattaaataaacttaagcaaggtatctttatcctgaaggaattcttagagatttcatcatgagtaagcacttttcagtatagaattgccaaaatacaaaagaacaccagagaaccactctaacttctaaaaaaaataagaaacccaaaaccttgtgattgaaaaaaaaaaaaaaagtaagaaaaagaggcccttagtcattctgttcccttttgggcctctatctttcatttcctctggggaaataaagttataaactgtgctggcagtaatctagggtgatgccaagtcagttacccacccccaactccatgtctccaaaagattctttaccaccctttgactctaattaaagaaaacaaatgtttccagttttctgtcatgtacctttccactctgaattatagaatagctttcttgaaattcttttaattgttttttacaaaggattagcattaaattcatagataaaaataaattagtaatagtgatcaaaatgacctaactccactttgtttttacttttcttctgggtaggagggcaaataacataactgcttatatggtgatttattttaaattgaatctgaatttctatttcttaaggcctcattggcttcatggcaaataagagagttttaaagaatttattgtgttaatttctgagaaaccaggagtttactgttgacaataatggcacaaattacaactcctacacagctctaccccctccacttttgagtttcaagacttttgccaaagttttctggtctttgttcacttctattattaacatctcttgtgtgaaggggaattttgaatgaatgggatgaaatcatctaaaccagcttcggtcctaaatatagtgtctggcatcaggtctgggaaaaaaaaaattggtcaaagagatagcctgaggttatttttaggaagttggatgtttagggaaattgatactatgaaagttctggcctctatctctgaagatattccattgagagatacatgcatgcattcaacatctcgtttttttccattcctgccctttgggtgttccgcgtcattcactatcttgtcattacagcattaagcagaagcttgaggcagaagatagctaatgcaacgtttccatttggtcctgtaatttttctgcacagagctttataggatttcatttcgggttaataaggggaagttggaaccgaggagaaagcttatgctctgccaacatatactgaggattactaaacttggaggtagaaaatagaacacaggaataaaaatggaaaagtcctggcagatttctccgtagcagacttcatccttaaaaagcagaattccatccagctcttcttggtggcataattccttatcatggaattataagataaatgctctgtttttatgcgtctctcttttctaaagttgaattgagtgtctgaaagacagatgatgtgtctaataccaccgttgttttacagaagggaaatctaagaaaactatagctaccctcctgggaaaacatatctaggcatttgctaacagtcatttaggctgcatctatgcacttccacacagaaggataaatgtcacatgttcgttgaatgatccagatgtttcaaatatacagttgttttatatttggtaaacaatgcagttaggtcatgtaaattttaatttttcatttggagtttatccctatgcaggcaatcatagattagaaagttatttttttcatgtcctacctctttgaattgtcaggttcttttaaatgctgttatgtagcaataaataatattttatccataatcaaggtggatgacttactggatatcagatattattattaacaaaaagtttactacattgtacaagtatcactagacaaagacaacctctagaaagttaattaaggtaactaaggttctcaactgcaaccacaaaactttcacagttaataataatttcacagttattaacataactttttcaagaggtactatactaaaccaaggatgctaaatataacttattaatttctgtgatggcttctggggatatcaatattggtatactttcctcactgcaatgaagacacttctgcatctacttttgagatttttttggtcatctttctagcagccagctgtcacctcttgctgctgtaacagttcctagtaatagttcccttattcttcaaacctgatgttagcagggaggtcagatactcaagcatgattagaattgtagaagcttgagcctcatatttaaatgtgtgtaaatatatgtttgaaaaagaattaatgagctcttaattgcagatcaaaggatatggtttgatagtgaagtggcccaatgaaagttgtttgaattttccttttgtctttctgtaaatggaactgtgttcttgaaagcctctacgtctttatcttgttcctcaagattcttagggcagtgcgtgtgggtcaggggtaggtgtgtctgggaattaagagtatctagttgatttagtagctatatttctcttctttagcctgtttattgggaaatgaaagacaatttaggctatttcattttcagtcagtgtctgttatgaattcattggaaatagcaatgtgaaaagaggaatgaatattgtagatttctttcattgtcatatttgtaaattactgggtgggatttataaacaaattattgactaattatgaacaaactgttgtttttttcttttcaatcaatatgaacaatcaagtgacctaacaaatttaattttaaaaatagatttgaaaggtatatagtagttaaaacaaggccccttgattcagattgcctgagttcatatctcaaataggctacttttttgtggtgtgcctttaggcaggatgcctcagtttcctcatatgtaaaaaagaaatgttaatagcagcttaccttgtggggttgttgtgagtgggtcaaatgacctactatgtgtaacgcactagagcagtgcttggctggagtaagctccatgtaaatgttagtccttgaatgaaagtagagctctggtagagatattccataaagacaaccttaaacatttttgaaccttttatgcctccaaaatatacacttccaaactcttctatcactgaccatattacttataccctaacaaggaagttattaagaatcataccagagtacaggaataaatcatgccagtcaggaaaaggggtacattggttattctatttataacattacttgagtatttataacaacaagtaaacaaaacgttttttagaaaaagaagagattactgtgttgtacaaatattactagatgggtaatttctctcctttttttccaatgtattccagaacccccatggatatcaaaattaaatgctcaaatcccttacataaaatggcatagtatctgtatactttaagcagattacttataatacctaatataatgtgaatgctatgtaaatagttgccatactgcatttttaaaattaatattattttttaatattttaacctttttttttttttttttttttttttttttttttttttttgagacggagtctcgctctgtcacccaggctggagtgcattggtgcaatctcagctcactgcaacctccacctcccaggttcaagcaattctacctgcctcagcccccaagtagctgggattgcaggcacaggccaccacacccacctaatttttgtgttcatagtagagacggggtttcgccgtcttggccaggctggtctcaaactcttgacctcaagtgatccgcccaccttggcctcccagagtgctgggattacaggcatgaaccaccgcgctcggccacatgtttttaacttttatttttccaatatttttgatctatgattggttgaatttgtggaagccaaacccacagacatggagagccagctgtgtattgttattgtcatgtcttttattctcccctgttcttttctgcctaaatgccttaggtacttctttacagagttagatagcatttaccattgataccacccagagtggtgtggtttgcttctcctgaccctttcatgagcaaagctggtttcaggggaaactcagggatctgaactgttagtaacactgattagaaatgcagcagttttattcaggccttggttttattgaccatttttggttggctcttatctctgtgactgatcatgtatgcgtatttcaaatggataaataaactaaaaagtgtttaatactccaaaatgattagaagtgtattgttaaataccaaaaagaaaataattctggggtgtttcagcatgttattctgttaacatagttcacgttgagtgtttgtattcatttgttgtttgtttgtttgtaagtaacaggttttgactaaaattccacggactgtggaacagcacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaaaaaaaaaaaaattaagtcatgtagatgcgtactttgaggtacaaccacgtgaatgattgtgccaaattattatgacagaaaagtctattgttgatttagaaaaagaattaacactgggcatcatttgaataatgggctttataaagaactgcacatattggttactggtagtaaaattcacagaatgttagatataaaaagtcctaaagggtacaaggaaaacttggtttgtcctaggtcaactagtaagattaatctacaacccaggcttctgactctatttcaacattcttctcataatgtcattgaggttacacttaataaacaacgttaaacactctctcttttaaaaaaaattgttggctatacatgttggctcacgcctgtaatcccagcactttgggaggctgaggcaggtggatcaccagagttcaggagttcgagaccagcctggccaacatggtgaaaccccgtctctactaaaactacaaaaattagctgggcatggttgcaagtgcctataatcccagctacttgggatactgaggcaggagaatcgctggaacccgggaggcagaggttgcagtgagctgaaatcgcacattgccctccagcctgggcgacaagagcaaaacttcatcccctcccccccaaaaaattgttaactactacaagcataaatatgaatatctacttacctgcatttctgaagctagaccataagtattaacagtgcttatatctacagtccctggcagatagtcggtgtaagaaatatagattaattgaatgaatcatatgatcatggttaaggttcttcttttgtgcgttttagcatttttaaatttttacattgatcatgtattgcttttgaaattttaaaaaacctggcaaaatgtaattacgatagaaactgacatcaaaaagctttgtagctgaaatagtgtaattttacactgagtttgaaacttctgatatcaggaactttgatgagcctaatacaggtgctatacgggatgaagtgaatatgcttagaatttttgatgaaaacaaatctgactactcaggtttctctatgagaagggtaggcagtttgatttgtaattatgggaagctgaatgtgaggcttggatgaggctttgtcagtatcagaccagctccttcctattgggggctgaattcccttgggctctccatcagagagaccaacaggaagcaatcatgtagttcttccaacacactcagaagtcagtaggtccactccacaaataaattgtaattggccatatagtaaaatatttggtagtgttattcttgtccttttccatatgtacaagagagaaaaataaaacaacttcacatcctcctaagcaagtgatcgagtttagatatttgtcccctccaaatctcatgttgaaatgcgacctcctcatgttggaggtggggcctcactggaggtgattgggtcataggttccctcccagtggtaatgagtgagttcttactctgttagttcatgcaagaattgatggtttaaaagagtctggtgattctctcccctctctcctgcctgtgctctcaccatgtgacatgtctattcctccttcaccttccagcatgattgcaagcttcctgagttcctgaccagaagcagatgctggcaccacactttgtgtatagcctttagaaccatgagccaaatcaaccacttttctttatgaattattcagtcccaggtattcctttatagcaacacaaaacaggcaaataccggagcaacagatcagaataaataacgctgagaggacctgacctgatttgctataggtattgttctagggtagcccctggtatccattgaagactctgaccgtgagctctgcctgcattaatataactggaccaaaggaaacagaactttagttttatgaatgggtgtctctccaaacaatttttcctggctgagctttgttcattaacatttttcaatttctaaagaacaaataatctccatttctctttttatgtccggcccactctcctgatagatataacctccctcctgtttagttccatgaattgtactccagctgcccaaacctgagaaaaggaattaatgactcattctctctgttgagtgagggcttattccagctggctcgcgctattctgtgtgtatggattctgtcagcagggttgaaataagatgttaactggcagttattcattaatttacagcaagaacaatgacttgactctatgtcaaccatttctgaaacattttgactaacatttttcctgttgcttagaactgaacttaaaagctgggacaggcatatggaaagaagcaaggatccccagttatgctgattggaactaggactaatggttttaacacagaatgtttatgcatgtagaatgaaatacacacacacacacacacacacacacacacacatacacgcacatacaaggggtcatactttatgtttgcattttcctctaaaagtatccctaagagtatttgtggttagtactacatttttttcatcatagtttgtttaaaagataaagcagatattataattattttctttacaggtgggaatgagttaaacaataattaactgaacaaaagcaatgtccaggtactgcaaaactttacataaattactcctattcattttcacagcaaccctctgaagtaaatggtattatcccaacttacagatgtggaaactaatactaattaacttacctagaatcgaggtggcagagccaagacacgaattcaagtttctcttcctcaaatttaacattctttcttgtacaaatgtaaatgttctttaaaaatgaatacataatggcaggattcatatcaattttctgccagaattaccatgtttacctgaagtaaaatatgctcataaacaaagcagaaagtgcagctggtgcttacatctaggatgattaactggcatgtacagaatttttttttccttcaattgcaaagtgaatgcagtaaaattacagggcaatgggtttcttcccacacaagacaaggtgatctgaatgatatagaagagaaatgccacatgtggaaataatatatcaaggatttattatgtgtctgtggtcattcttaaggtcatttttgatgtctacacatttcagcatttgagaagttgtatattacatgcatacaaacccatattcaaatatacaattggctaaacaagtatttgttttaataaagtagtagtaataaaatatttatagcaaaggggacaagactcaggactgagaggaaaaactcaattaaaaaaaagacaacaatacttaaatctcttgatgcatctacttagcaatgtctacaatagcttttttaacactatcagaatatagagcataaattataatgtttatcctgcttttaaaggaaaatttttctcttatgcaatcatggtgggagaaaagaattcttaacgtgattatttgtctcatattttattttaggattctgttagtgtttttaggattctatcaatgcaaggtgtaagaacatgtcctggcagttgaaggaaaggctaaggaaaaagatgaaagagaagtgtcgcatcccttaccctccttttaaagaaatgctgaagttgctgagcagaaggtgccacagtcatgtcccttaatttatccctcaaccttttccagaagtaaagtgactacacctaagctcagacagtgacagtcgtgggagaaaagctttatagaaacagtgataggaataaaagtgtgtgcactgggatagatgtattttttaattacagaagtaactactaatctatataagagaggctccttccactctcagagcttccaacttaaccatctgtgaagagtaggtccttcaaaaccaactgtagcggcaaagttctgagatgatatttccagactcagcagataggaacaggcatgctaggtgagatatggcagggaatattagtcagggttctccagagggacagaaccaatttgtgtgtgtgcgtgtgtgtgtgtgtgtgtgtgtgtgtgtgtgtgtgtgtgtgtgtgacagagacagacagaaagagagtgctttagtttaaggaattggctcacaattatggagactggcaaatctaaaatcttcaggctgggttggcagtctagagactcaggaaaagctgatgttgcagtttaagttcataagatttctgttgtcagaattctctcttgtttggggagaggtcagtcttttgttctattcagatcttcaaccgattgaatcagccccactcaccttatggaggacaatttgcttgactcgaagttcattgatttaaatgtaaatcttgtctgaaaacaccctcctagaaatattcagaataacgtttgacaaaatatccagggaccagggaccatggcccagccaagttgacacactgaactgaccattacaagtctagttggcacccatatacatctccttaagccattcttaatctccaaatgtggtcacattctgaggaactggtggttagagcttcaacatatgcattttgaggagatacagtgtagtccacatcatggaggtagccctagaatttttttgtttccattcctattggcagagacaattgaggaaaagggaaagttccctttcatttattttactctcctgcacatctaatctttaaggagagaatagaatgagagttggggcacaaaacaaggattgaagggcagctgacttgagtccacgtagccccagaacaaagcaaaggaacattagattagtggggtagtagagattaaagaagtaaacagaattgaaactggcagaagatagggtcattgtagagtggaaaaacatatctgaaacatggttgttaagtcataagctaatatttggaaagacagactccacttacttttttccaatagatatatatttactaaaatcttgggaaagctaagcttatgatcaggtgtaaccaggccatatcccttgggtcccaaagtcaataagcagggagagcttggtgtttaagtccttaggaatgggtcatgccactcagaaaagagaagagatgtttcgatctgtggattgttatcatctgcaacccaggaggctctttgattcttcatatcacgttatttttacctgaggattgtagataccctacagtcttaaagcctctggccaatctgccttggaaccacaggatacattaggcaaggtctggggctggctttgacaaaggacacagtattgctggcagaagaaatcactcttaaagggaatatagatgctactgtgagagactgatcaactaattaagatcttgttgaagattctcaaattgagtttgagcttgttgacaaaaaccaggcttaggcagagggatgatgatcctgagagcatcctatctccatcaataggagtatgttttcaacctagtggtttttttttttaatttttattttaggttccagggtacatatgcagatttgttatataggtaaactaatgtcataggggtttgtaatacaggttacttcatcacccagggattaagcctgttacccaataggtattttttctgatcctctccctcctcctaccctccaccctccaccctcaagtaggccccagtgtctctttttcacctctatgtgtccatgagttttcatcctttagctcccgcttattagtgagaacatgtagtatttggttttctgttcatgtgtcagtttgctaaggatgttggcctccattcttgccatgaaaaacaacaggaaaataaagcactacccttgagcatgcctctagaacttgaggttcaagaacaacagaagagtggcagaaaactatatcttaaatatattctttatcttttgtcagtcctcaatctggcaagaacattgctgctacctgacctcatagacatgcatttgaactcctacttttagtatctgctctaagatctgatttaagaacagatagtagaatagaataagcttggttctctaggtatcaattttcccaaatttcacagtagttctatgtacagtcacattgtatattataaaatatatgtttaactgtcacatgcaagtatatttcagtttttaaaagctcaaggtgcatgctgatagtcactataaataaataaatacatatgtcaacatctccctatccccaattcctccctcatcaaaaactaaataaagggcaaatgaataaataaataaaaatgtttaaactgctgaccttcctgtcaacaaaggtgatgtgagttacaagaatctgttttctagctggagatgtgggcgcagtcatgagtatgcctccaccattaacagcactaaacccaacgtactcacaaacaacagctgcatgaaaaggccaagcttagtatcatgtgtaatttatgagagcttgttaaaacacatacatgcacacaaagttgaatgaataataccaggtgatggttaggaaacagaaaattcctgaagcatctcttctttttaatgaagtatcaaaaatactgttttattaaaatcgggagaaaaaaggctttaggccaagtgtgttgggttggccttgcaactctacttcggttacaaatttaaaggccaaagagttagagattgtgtatatgggtatgtgtgttgcaggttggggtgtgggacatatcaatacaataggtaaaatgaatggtggattgtgtctgggataatgtggcatattttatctcaaatcccaaccttatctcccaataggagatttggatcatgagcaagatttggcttaggctagttttcaattcccaggattccagctccttcatagcaccacccttatgcttactaatcccttcatctttaagacacctggataatgagctatctgcatggttggaaatagtctgggtttgttctaaattttacattagataacaggtcagcaacaaaataatgggagggggaaattagaaaacattaagtcttatttcatgtcatgtgatacagtatatatgtatttttttaataaaagaaagtgacatatattgtagttcaattggatatttacatttcatgtagaccataatggtagcggtaattatagaaatcttagcaactttcaaaggaaatttttcccagcaagatgactgacaaaatttttgaaagtaatagagagaaactgaggcataaaatttacctgaaagcagtcctgtttaaattggacaaaataattaccttttcttacatccctcttttagagttttcctaatatcatttaatacatagatagtactagaaagaaaaagacattttaaattaagaccaatgtgaagcattatacccatttagtatcattttgcccattacccttatagaaactaaaaatagaatgagtgctcagagtttgtactgtaactgcctgccacttacatgggataactatttttagttccatcgtccttattaaaggctttcattatgagttcatttatggaaatgttatctcacagagttttttttggagacttttctgagatctcaaaatgaggtctcagaaacatgattagaacatagtcatttagtttcccagcaaatgctgatcctttccaggaaagttctataaataaggaaccaaagctggttgtcagtaatttgaagtagctgggttggaccgtgaatattaatatgtaaattatagcttgtgccatctatacacaaccaggattgtatgcatatcttcccatggtttattttaagtctgaatttgcatacaaacactggtctaattgagtttttaaaaaaaattcttaagagatgccatgtgttacttaaagatgttttgttttgaaactttgtgataggtaagatccactaatgtttgtaaaatttaccatttgtaggaaatattctattctcagtaattcctggtgaaagtggtaggtgggttagagatcataaaatccagtcttcacgggaccaagctggaacatggctgggtagctggtggggtagtgacagccctgcttcaaggagagatcagaaatgagggatgagactgagtgcaaagtcaaggtcaacacaggctaatcttggcttttggctacttttctgtaaagagtaatgtttctctatttgaaggagtgattttaattcagaagtatattggaaaagtgaaagaattcctagagaaaagttaatcccagacaagatagtgaatgacatatagtttattatccagtgacctttagcacaacaactacacatatgcgcaagcgtaactgctgggctgctctggagttcgccagaaaccccttgcccttagtttgaaggagggaaagaaatatctgtaattattgctctatatcctttgcttttgacataattgattctctggcatttaaaatttatatccactcgcccataggattcttttaactctttcattgtttatttccttgtataagaacaggtctgctagtcagagagaatgttgagtatctttcataatccttgtctttatgggaccaaacatttctgccttgtgctagaaagatttttcagcccagccccaggcaaccaccattcattctactctctgcttctatgagtttgactattttagttacctcacaaatgcttttgctgcatttgttttgtattttaattacaccgtttgatggcaatgctagaaatttaggagctacagctcctctctaacatgaatgctatcttgtcaatgccttcagaagaataaagatcataattctttcttttacattgtgatttctataagaatagtttcctatcttcctggatctagatggaagatattaactttcagactaactgttcactggacaatttttctttcattattcctaaggtctttattgtacatatgatggtgtctccaatagttaaatatgcctctaactacaacatataatttaaactcatacctcacctgggattatattgatgatttttggttcaactatttctcaaatttgagatgctattcagaatttaagtgaggtctaataccataggcagggattagaagtccaggccagaagtctgaagtcatcagcttgggttctgttgatgtgaagtgaattggatcacacagagatagacatggccacagtcaggtgtgatacttgatgtgcctatgctttgcctcttagccagttcttagtcattccatgcaccgtgctccttagtagaagagagaacccttcaggtagacttctgtgaaatcctcacaaggcacagaaatttaatggcatttctgagagtcacaagggttctgtgaagtagaaattatgctctcattacattagcttaatgctgagtatattgggactcttgtaaatggacattttgttcatggatattttgttttagcaatttaaagaatgttaactagcttaatattttagagtgaacattttaaagtgataaagaaaaataagaaactttcttatctcaattaaaaatatatatgtatttttggtccacacaaatcacatcacccaaataattcagagcactttgctagaaaaggcaagacaaggtgtttctgagagtgtctccgcatttagatagactatttagttccatacttagagatcatccactagggtttctttgagcttggtgaagaatattcagcaacttgcctaagctctgggaatgtgagcatcagttatgaatataggtcatctcagtttgtgcacagcacactttctgtcagtccaatataaacttgtatgagtagatctgtttattgtgataactacaacttatattaacttgttgacatgctttttctaacttattttcttgggtctgcatttttcaaagatcaaaatttctgcatcttcagcacaagtagattgaagaacacataatacggatagtgattaggaacattcaggcatggggaacgggtgacatattgtttactgtgtttaaaagatgtgttataaatttcacttagtcaaactaacttgatgaaatcaagatagcctatgaggaagaataagctctgcaacttacatttttatatgggaagaaataatgagtcagtcttcttgaagttttttacattattatagtaagaacatttaagatgagatatacccttttaacactttacattttaagtgttcaatatagcattgttaactctagataggacgtttcatagaagatcttagcatctgacgtaactgaaactacatgcatcgaatagcatctccccatttctcccacttcccagccccaggcaaccaccattcattttactctctgcttctgtgagtttgactattttacatacctcattgataatggtttggatgtttgtcctctccaaatcgcatgtagaaacatgattcccattgttggagatggggtctaatgggaggagattggatcgtgggggcagatccctcatgaatggcttagtaccatctgcttggtgataagtaagtttttgctctgagttcatgtgagatctggttgtttaaaagtgtgtagcacctccccaaccgatctcttccccttttgccttccaccatgattatgagcttcctgaggccctcactagaaatagatgctggagccgtggtggtacagcatgcaggactgtgaatcaattaaacctcttttatttcttaaattacccagcctcaggtatttcttttctttctttttttttttttttttgagatggactgtcactctgtcactcaggctggagtggagtggctcactgcaaccttcgcctcccgggttcaagcaattcttctgcctctgcctcctgagtagctgggactacaggtgcgtgtgcccacgcccagctaatttttgtatttttggtagagacagggtttcaccatattagccaggctgctcttgaacttctgaccttgtgatctgcccgcctcaggctcccaaagtgctgggattacaggcgtgaggcgctgcgcctaaccatatttctttatagtaatgcaaatggcctaacacacttatgtaagtgaaatcatgcagcatttgtcgttcttgactgggttatttcctttagtgtgatgtcttccaggcacatccacattgtcgcatataatgaagttttaataactgttctaagacttagctgaagtcaaatggaatgcttctggtacttccctcatagcttatctcctggccttgactatggccatttcctattcccaccctgctctccaaggtggtattctagccatccttcaaggtcctgtgcgaataccatctcctctaggaaggcttcctttggtttcaaggcagagttcaatcgtaccccatctgaaaaccaatgacactttggagtacctcatgatagcccttcacaaacccctttaatgtgactgtgtgtgtatcgtctctctacagtgagaataaaagctccaaagccaggaactatatcttcctcacttcctcattctccacgggaccttgcgtttaataatttaacgaaaattcaacaagtatctgttgatggataaataatcatggaaaataaattccagacgaggtcagataaagtggattatatgggtaaacattgtggaaagtaagcttttcgaaatattgtaactggtgaaaagttgtccatcatagttaatgggctacctgagcaaatacctttcctgagctttttcttgaattcatagaaacttgggtctgaaagaaaacttacaagtcatcactttttttttttttttgagacaaagtctcagtctgttgccaggctggagtgcagtggtgcgatctgggctcattgcaacctccgcctcctgggttcaagcgatttttctgcctcagccttctgagtacctgggactacaggtgcacgccaccatgcccagctaatttttttgtatttttagtagagatggggtttcaccacgttggccaggatggtctcaatctcttgacctcatgatcctcctgcctcggcgtccaaaagtgctgggattacaggcgtgagccactgcgcctggcccaggtcatcacgtttagcctctcagtcctctatgttagaaaacagtaatccaaaaaaaaatgatttctttaatgctagatagtggctgaagtaggactagaactcaagtattttaaagcctgcttcacatttcttgttactaagctgcactgcctcccacacatggcctattttggtctctaaactgtcatgaaaacagatgctaggtccctgtcaaaatgtttgtgtatttctgggtgtgaaaaggtatgtgtgtgtatgtgtgtgtttgtgtctgtgctcatgtgcatggatccctggtggaggggagagaaaggcaatttgtagctgcagacttctgtcattgcacgcagcgcactctgccatggtgagttcatactccacagcaacagaacagctgctgcaaagggttggtgtgctattttcatcttgggtgtgtgttttgcatcaggctcttggcaatggcaagagtaaacctctgtaaagaacaccttcttaaccttttactgttacccacacttagtcaacagaaacaatatgtttaacaggagtttttcctgctggacagttaaatatgcagttcttgcatatgaaacatgaatattttgttcccttctgtggaatagcaataataataacactactagtaataccagctaaaatattttaagtgcttatttcaaacggaaaattttttttttaaatgccagattttttctctctagggcaacagtcatcttgtataactttgaattcacactaaaatcctctgtagcaacataaagatagaaaaatcctcctttcagcaatatggcactgtgtgcaatgagcaaatgcaatgatatagaaggaagattgagtttaagagtatcagcagcaaagtgacagaaacgctcatacattaaaaactaaaaattagacttaattggttataggtgggaggagcctattacttttggtgaggacacatataggtgggaaaaagagaaagaaaaaaagaacatatctatgacaggaagcttcacagatttcattttcataatactttttgagactaaaggaaatagaacattttctgtcatatgtgttccaagtaatgtcattctgtttctcatttgtcttttgacctggctgtataatgtatgtggtgaaacagaactcctttattattaattttttagtggctacattagtaactcttttcctgacaattatgaggaagctcttgtatattgacaagagcataaatctatcaacagccaggttcatacatagagtccacctcttaaaggttataagatactgggcaagtcatttcatttctttaaacctgtttcctcatctgtgaaatgctgatagaatcataccttacatagatcagatgtaaataaaatagtcgtaagttagcgctcaggaaattacagtattctgtgcaaatcttattaactttgattttgtttcatatattgataaatttacatctagctgaaaatacattgaatcattgtcatggactaaattttaatatgtcttaggaaaagagtccgggttgaagtgcagtggtgcgacgttggccccctgcagcctccgcctcacaggttcaagtgattctcctgcctcagcctcccgagaagctgggattataggtgcatgccatcagacccagctaatttttgtatttttagtagagatggggttttatcatgttgaccaggttgttctcgaactcttgacctcaggtgttctgccggcctcagcctcccaaagtgctgagattacaggcgtgagccactgcaccggtccaggacaagaatatttttgaaactatgagctttatcatcagagacattaaaacttcagaaggaaagagacctttgagttcttctgagccaactccttccttttatcactaccaacaacatgaagtcagagggaaatgacttgcctacagtaagatgagcaggaagaagtgaaagcagattaggggctgaggtcttcttagtttatgtccagagatctttccacttcacccaccatactctacattagtcactaccacgaccatcatcatcattatgaccaaaattaaatctaaacaacttttcaccaagtaattccattttcatgctaaagatcaggcagttcacttccatttcctcttttgtcagatgaaggaattgggccgggcgcggtggctcacacctgtaatcccagaactctgggaggccgaggtgggcggatcacgaggtcaggagatcgagaccatcctggctaacacggtgaaacctgtctctactaaaaatacaaaaaattagccaggcatagtggcgggtgcctgtagtcccagctactcaggtggctgaggcaggagaatggcgtgaacccgggaggcagagcttgcagtgagctgagatcacgccactgcactccagcctaggcgacagagcgagacttggtctcaaaaaaaaaaaaaaagaagtaattggatgaggtgatttatgtaattcctacaacctctcagtgctaacaaagcaacattcaatgacatttacaatgatcatggtggcaagttgggagagagaaagggcatttctgaagtaataataaaatgagtaaaataagatggtagtgccgtgtgttgatattgtgaactttacatttttactttctctcatccaaatcacagtaaaggagctgaaataagattttagttaattggtagccacacatgcccacaggctggtatgccaggctttgtttttctcacactgctgtaccatatccaaggccagagtgaatttcaggtgtcatgggctctacaagggcaagactggagtaggagctaaagtcaagttcccattggagaggattgaccaactgatagaggatggaaacgaagagccaaaggggagaagggacaggaagtactgagatctgaaagcaaattgcctaacatttagaggtgagaatgtgaaatgaggccaaccagggctggtgcagagccagaacaagggaggtcagaaagctaaggtgaaattctggaaataaatatgatgagagcttattgtaggggagacttttgggggactatggcctcgatctgatgtgtctgcttgtccccagtgctccttcaaacatgctccttgaagcttcatgcctgccttagacagccagagattgaaaatgaacatatattttgaaaacaaagacactaagaccattcacaaaaattcaagaagtaattttttaaaaaaaatacagtaacatttaaaaaatatatgttatttcacaacatatgtaaaaccattaaaatacattgacatcccaacacatattttggggtgtcaaaaaagaaatatggcagggtgcagtggctcgtggctgtaatcccagcactctgggaagctgaagcaagaggatcgcttgagcccagttctagactaacctgggcaacatggcaaaaccttgtctctacaaaaaatagaaaaacttagctgggcctggtggtgtgtgcttgtagtaacagctgctcaagaggctgaggcaagaggattgcttgagcccaagagtttaaggctgcagtaaactaagctatgatcatgacactgcattccagcctgggtgacagagcaagaccctgtctcaaaaaaaaaaaaaaaaaagaaaaagaaaaaaaatagaaatagtatatgttgataggaagcttagtgaagaacattaaaaagatttgcttgagctcttggttgccatggcagagctgcgggagctccgggctcagaagatggtggactctataaagaagcctcttgagggagttacatctgggagttgtaatttttcatgttcagcaccagatgttttgaggacaggcaggtgtttatgcagcaggtgtggcagtgcacagaggactgccacatgcctctggctcaagaccaagccttgaggaccacggagataaagaagttccaatgccacctgtcccagtgcaccatgcattgcaacgacaaagccagagattcactagatgcagggagtgaggatctttaggcgaagtgacagctggacagttgtgtgaccaagtgttgatcacatgcatgtcaccctgacaatgaccaaggagatgaaggagatgttctcatccactgggatacgtatcttggccagtaaccatcagggctgaggacaggaatctgtttaacaaaaggaaggagaattttagtctttaaggatgtggggaaaagaaagagagatcagactgttattgtgtctatgtagaaagaagtagacgtgagagactccattttgttttgtactaagaaaaattcttctgccttgagatgctgttaatctgtaaccctagccccaaccgtgtgctcgcagagacatgtgctgtgttgactcaaagtttaatggatttagggctatgcaggatgtgcatagcccgagaaacacccacaggtgtggaggggcaggccaccccttcaaaggcaagtgtcatgaatgaagaaattaaggatagcaacaagtataaggcctatgtcacttgcctttggacaaaggtccctttatatttcaatcctggaaagtgaaatgaaaaaactagtgctaaaattaggatcaaagatagtacaggaaagtgtatttaagtcaaaatttcatgtggcaagtgcttctcctggcagcaggaatatccttgtaccaagccagagccttccaaggtacaagttctttttcactatataggaaccgacagactggcagggtcctctaatctggctgtgatctggtggagtttgaggagaggtgtttctgtttggtgtgaggctcctgtttaccagaagtgttgctgcaccattttccataaacaataaaacaaaatccatgagataattcatttagtggggcaaaaaacgtttgttggtctttgttttgcttggttttgttttatatgtacaagggcataaagttgacttaggatgtggagttgggaaggagagtagtttggataagatctttgaaaggttgcttatgggtatcctttcctggtcatcaagatgtggatgtacctctcttgaaattcttactcactgcatctttcagcctggatatgatgcaaaaacatgagcggtgacttcacatttaggtttgaaagcagagcttccctcttattggctgatggttcctgaggatgtctgcagcagagtggcaggacaatctagcagaaatattttccacttaaagagatagggggtttgtgtttggatttggttctgatatatacctgtatccaggaataaacagtgaaagaggaaccgttggctacataattatgagagttgtgaagtgctgaatttggaaaaacccggctttcatagaacagaatggaatgaaagcccaaacccagcattgcttacgtagcccctgaattaacagaaccctattgagataataccctgccaacagcaaggtcaaagaagaagaagtaagcgacttggctaggatgagctgtgacttccttagagcaaaggaggggcagccccattaccaaataccacttttgcccaggcttttgtgacatgcagtgctcctgcccagcatggcaccttattttgacaaggaccttgttatctttccaccaagttatcacttgaaatgataatatagcttgtatgttgttcccaagctgtcgtatattttcctggttgtttgaatttaacaatgagaataataaggtttaatactcctccctaagaaaagatttgcttatttcccaatttgaaattactttgctaagagggatataatgagttctatagtgaaacaagtatgtgttttatcctaatttctgaaattattcctgaaaattcaagtccattgtttgtctcccaccctatcctttggttctgtcacctcagaactaacaccttgacaaagtgtttcttttttgtccttctaccctccccgcaaaagtttattttttaataaatcgtttctggcaccaacccaaaccacaattacttaaaaagaaaaaaaaaatagcccaggattccatttacttataaacttgctttctgaactttatttttaatttcagcatttttttttttttttttgagatggggtctcgctctgtcgccaggctggagtgcactggcgtgatctcggctcactgcaacctctgtctccctggttcaagcgattctcctgccttagcctcccaagtagctgggattacaggcacacgccatcatgcccagctaatttttgtatttttagtagagacagggtttcaccatgttggccaggatggtcttaatctcctgacctcgtgatccacctgcctccgcctcccaaagtgctgggattacaggcgtgagcctctgcgccgtgccattttcagcattttttgatgtcagttatgggttcattgttttcaatataagataacatgagcagagactgtgtaggtgggattgagagtgaagactgggctcattgacaacctctcatcatctcgtcaagcagagtttcccatatcctctgaatctatgcctgtgtaactccaaatattagcataaatataaaaaattcatccatttggatattttatctacatgatattaattattgaaatgaatctaaattcttttcacaatgattttggcaagaagcactggcttggagtaaagtcagaaaacatgacacatagcaaacatttatagaccatctttttaattgtccatatgaaaagaataacatctagctgattagatgtattttaggggaatttgggaaagaataaataactctatgccttatgactgtcctgatatctgctatttatatctctgttctgggcaaagaacaccaaaaccgaatgaattaattgttgtgcatgctattatgtcttggatatagtaatatcaacatttatacaaatatcgactcagtacagataaaaaatagaaagtaattttcatcttttgtttttaaagaaggaaaaatattattatagaccctgaaccttcttcttcactgaatgggaggaaataaaagatatagaagcctgaggaatataaaataataagaaggtaatgtgatagaaagtggctgaggctatgtagtttgaatctccagaaaaggcctctctgagaaggagactttgagcttggagatctgagtaacaagaagaagccaaccatgcagggaacagtatttcaggcagagggaatagcaagcacaaatgctcaggtgtgaatgattccagctgtggtagccagagtctatgatgcaagggctaggaggggtggtagtgaaaggagtttgcattgtatttgaacaccaggaggaaaccaacacgtagcattaagcaaaaagtggtatgatatgatttatagtttcaaaagattacaatggttgttctgtaagaagataccagaagaagcaaggagaccagatgtggctattttaaaaatttttcgttgatacataataactatacatatttatgggatacatgtgatattttgatatacacatacaatgtgtaatgatcaaatcacacacttaacatatctgtcacctcaaacattatcatttctttgtgttgggaacatttcagatctgttcttctagctatctggaaatataaaatatattattgttaattatatgtcttaggctgtttgtgttgttataaaattaatttataaagaaaaatatttatttggttcacgtttgtgatgtctggaaaaattcaaaattgggcatctgtatttggtgaaggccacaggccacttcccctcatggaggaaggtatagagagcccgtatgtgcagagattacatggtgagagaggaaacaagaagggaacaggaggaaactagcagaggaagaactcactcttagtttctgcaagaggaattaactcactcccgatctccccactccctgggtaaggcattaatctatttatgaaggtttcacatctatgacccaaacaccttccattaagccccaccttcaacactgggaatcaaatttcaacatgaggtgtatagaggcaaacatccaaactgtagcactatagtcactcgaatgtgctgttgcacactaggacttatttattccttctatctaactgtatgtttttgcacattaaccaaactgtcttcattcctcactccctcatccttccctgccttcagtactatatttctactctttatcttcataagattcacttttcagcttccacatatgaatgagaacatgcaatatttgtgcttttgtgtcaggcttatttcatgtaacataatgacctccaattccatctatgttgctgcaaatgacaggatttcattctttcttgtggctaaataatattctgttgtacacatttaccacattttctttatccatttactcattgatggatatttaggttactttcatatactgttattgtgattagtgcaacaataaacataggtgtgaagttatccctttgatgtgcttttttccttttctttggatcagtccccaaattgagattgctggatcatatggtagttctatttttagttctttgaggagtctccagactgttttccttaatggctatgcaaatttccattcaacagcgtataaaagttccattttctcggcatctttgtcagcatttgtaaaattttttttgtctttttgataataaccatactaactagggtaagataatacctcattgtggttttgatttgcatttcccaaataattccaggaaagagatgacattgggttagattagaggggaaccaggggatgagtacaaaagatgaggagaagttagaatctattttagaaacagagtcaacagaactcaccaaatagatgcagttaaggaagcaaggaaagtaactaagggtaacacctgtttgtggcttaagtaactgaataaatgggggtaagacaatatgagacagcaaatatttggggaatattttatgtggtatttttggaaaaaggtgaaaatgttattaatttaaaatctattatgcttccaattgaagatgaaaagaattgcctagaaaagtctggaactcaaggaagaggtcagggctggagatataaatttagaagacattggaatataggtttaattaaagccagttggccagatgagatcctccatgtaaagattatagatagagaagataagagggatcaaaaccaagccttggggaattccagtattaagagttgccagagaaagaaaccaacaaagacagaaaaagcaatcagtacggtgggaagaaaccaagagggcctgatgtcataaaggcatttcaggctagagaaagtgtttaattaaagagaagaaagaagaacttccattgcatttggcaatggaggtcacatttgtgatctggacaggatagttgcagagagtaatgagtttaagttgtacatcaaagtaaaagacacacactctggccaaaggaacagccacagaaggctggcatatgatgtgcctggcacgcaagttttggttttgtcctttggattctcctgttagatatatgtggctgttaaacaaggtctcagaaataacggcttggtaatggatgattctgacaggatacaagaaatcccagagtgttaagctcatcaggtttattgttagttcttgtttcctggaagtgtttgaagccttgactctattaggtgaaatatgactccattaaattgtctgacattttaatactttaatttagtgccagggaccacttttagtgtaaaatgtttcacagagggttctattttaaactgcctggcttttgtaactctcagttttttcttccaagcctttcaccagtgtaaccatcccaaatttgcatcttgtctgatgctaactgaggaagaagggcacctggagtttgaccagcaggaacaaaacatgttaaaattgttgcagaagatgatgaggtaaaaacacatagcactggggcacaaaaccctggagcctggagcctgttgcaggtgtttagcactgaccttccacataaccatgggtagccataggacctctttaaccctcagttttcacatttgtaaaggcagtgagcaggaattgcattttaaatatacaattgttgtcactggtagcatctatctggggccagtggcacaggagtaaagagaatttacccagacagttgtgaggaaagaaagccatattgattagagaaagcatgaaaatacgttgcaagggtgcaatgggcaaatcagcaagataggagctgactgcaaggagacaaaggcttgctggggattttatgggatggcgcttgtgctggggagggctatgtgctttactgataatgccaaagttgtagtaagctaacttgcagttttctattgtctgagggtctgatagtaagttgggcatgagaagattgttagtaatttgcacagaagggctatgtgtcctggaccatgaagaaaggcagacttgtagcttatctgctttttctttttggtttctcctgctcccaacaacctgactccttttctctaattaggacttcacaagtgtggcatctcatgtattctaaagtatatggtgaccatctaaggaagttggtttgaatgtgcaggtctagcaaagaacatgccctggatataaaacctaggaatcaccatctgatcgaagatggagatgaatgacttcaccctagggcaagaaggacttaagaagaataggaaggatggcaggaatggaggaaaacattttggatggaaagatgagacactgaaacaatttgaagattggaaggtgagagtctgaggtccaaagctttacaccagttgttgaagaaccttgatcacaggccagccaggacctcaaaggctcaagagaaatgatgacaaggtttgcttggcttatttagagctgggctatagagcgggaagattgtggttaaatcttagcagaactgataaaaagcatgaagttgtactgagagatttttcaactgtacatagttgcagaaagaaacaacctgctaccatagtaaatatttgtgttagaactcagtggatgaaggtggaggggggaacatggactggaggggctaacagagtatatgtagtaggcaagtgggattggagtacaagggaaggatagctgggggtgacgaggttgagtctgtgaatgagaagggcttaggtcaatttctctttctacccttcttccagctcttctcctccctctttattcctcccctcttccccttccccctcttttcctccttccctctgcctcctctcttcttcctcctttctgcctttactttatcctttaaagtcttaaaaaacaaaacaaaacaaaacaaaacaaaaactgtgatgatagaacccaaagtgtactgagagatttcttaactgtgggcaggattgttaagtggtagtaaactcaagacaacatttatattgcactttacaatacataaagcactttcacgtaattaactcctttgatttgatcatcacaacaatgcctgaggctaatagttataaaccttgttactgatgaagaagctgaaattcttatcagttaaatgtgttgctttgggcttagtaattggcagagcaagccaagtctgtctccagaccccgtggtcttctggttccaaattccatgctcttctcattatacagcacaatactttttttttttataaaatgggaaagtctttttttttaatgtatttacagacagttcatggctttagacacacacacaataaagccatttttattaaatataagaaagtggagcaaatttgcgtccttttttattttctaatgacaatgctaaaagctaaaaggcaattggccattgacgggagaacaaaggaacctgaataattgataaaatgtattctaaatccagaaactgtcaaagtaggcgatgtcagagatgctgcagttgcttggttgttcgtgatatctgatgacgctgcatctcagtcataaaaacttcagggaatctgaaagaaataataatgcgccatggtattttgagcttatcaccacaagaaatactctgtaattgcatcaaatgattataaatggcatattttagggacataataagcaatgcaaaggacaggtctgcttattagtgccaaaatttgtatttattcccatattgctttttttttcctaggcattttccggcatctcatttctgactattaaattataccccaaatagaatatgtaactacatgtaaccaacctattttggtctacattaagtgcagcagcataaatagaaactgaaaataatcagaagcatttagaatttcgtttttattcatctgatttacttggccttttgtctgggatgtaagtgattctgagcccctctccagactcacactttccccaggtttcagtacctggggctcacaatctcagtggaagagtttcaaggcaatcttccactcaggactccttatgccttgcatgcacacaaagcagcgttgctcaaaacataggaaacaactatgaggaataaaaaggaaaagcttgttccttaaagaacgagaaggaggccagcagtctttttcataccttcttgtttatagaaagcagatttttttttttttttttttttagtaaaagcatatttggagcaggaaagaaatatgacctagactgtgttgttttcttttattgtatctacaaatagtttagctgaagtgagcttttcagttattgattttaaatcataagtttaattcgtcatcaaggcaacaacaaatgtgatgtttggggcagatgcaaagttgaagtatgtctaaagaaatagcacgctagttgcgtttaatgtggaaggtaaattataacaaaacaaactaaaaccccacaaactctaaagattttcccttatagttatagaaattaggaaatgccctattgtgcatctttccttcccaactgtaccgagattttgaattttttataatttgtactaatatgtaactagaccagatataatctgttgaggctttcttgtgatggaaagcaggtgaaatcaattttcagttgaaatatgcttttcagttcactatatgatgtttgtagggcttttttagagaagggctttgcatttagacttgagcagtttagcaggcttcgtcggagggtaaatctggctgctggatctagttggaatgttttcctttcataagaagagttggagataaagtgattcttgctttcaaatacacttttaacaatacaaaagaataattgaagactttttcttttgagacagagtctcactctgttgcccaggatggaatgcagcggaacaatttcgactcattgtagcctcgacctctcaggctcaggtgatcctcctacctcagcctcccaagtagctgggactacaggcgtgtgccaccacatctggctaatttttgtatgttttgtagagttggggttttgctatgttgcccaggctggtcttgaactcctgggctcaagctttcctccctccttggcatcccagagtgctgggattacaggtgtaagccactgatcccagcctaattgaagacttttgtatgttaggtgctaagtaatacaaaagtaaaagtgccactgtttctgtcctcaaggaatttacagtctggagaaggagacaaaatataaacaaacacactgataagtaaatgattacaaattgtgccaagtgccatgatagaaaagaattgatgtgcattatctctgtgctccctgttaggggcacctgacccatcaggaaggccattgatcatacccatcagtcttccaggtataccaaggacattggattgaatgtcacaggacctggattcaagccctgccatcgaatccagctgggtgtttctgggcttcagtttctgtatattcagtaatagtatcgaatattagtgggagtaatagcattgaatgccctccatgctcactggaacttcatccacaattacaatgtcttggtggctttctaagtttttttttaatttttaatttctaatttttgtaggtacacagtaggtgtctatatttatggggtatgtgagatattttgataaaggcatgcaatgcataataatcacatcatggaaaatggggtatccatctcctcaagcatttatcctttgtgttacaaacaattcaattatgttttttaagttattttaaaatgtacaaatacattattttggctatagtcacactgtcatgctattaaatgctaggtcttctaattattttttgtaccctttaaccatctctacctctccctgatcccccagtacccttcctatcctctggtaaccatccttccattctctatctccatgggttcagttgttttgatttttacattcagtaaatgagtaagaatacacaatgtttgtctttctgttcctggcttatttcacttaacatgatgaccacagttccatccatattgttgcaaataacaggatctcattgttttcatgaataaatagtactccattgtttatatgtaccacaatttctttgtccattcatgtgttgatggatacttaggttgcttccaaatattggctattgtgaacagtgctgcaacaaacatggatgtgcaggtatctctttgacatgctgatttcctttcttttgggaatatacccagcagtgggattgctggatcatatggtagctctgtatttagttttttggggaaatcccaaactgctcttcattgtggttgtactcatttacattcctagtggctttctagaacctcctcttggggagccatatggaaattttgctgaaggtgagaatatggcagcttgatgcaatgcagtgttttttcaagcttcttaatttgttgttgttttgagacctaagtctcaggagagatgcaccgaggctgctgcagagctgtagagaggagatgaggagcgagcaaaggaggtagggttggaggcgcagggcatctcccaccctgacttgtctcagacatgcccctcctttatctgttgattataccaggcttacagggaggattttatccaaagaattcacctgctaaaagaggaaaacattttaaaattactgttgtagtccaaatagtctctggaactagacgattctggattccaaatatagacatgtggtgcttaacgacagggatactttgataaatgcattattagactattttgtacttgtgtgaacatcacagagtgcacttacatgaaccctgatggcaaaacatactacagacatactacatactaggcttatgtggtctagcctcttactcctaggctacaaatctgtacggcatgttactgtacttaatactgtaggcaattgttaatacagtggtatttgtttatctaaactatcaaaacctagaaaaggcacagtaaaatatggtataaaagattttatttaaagtacacctatataaggcacttcccatgaatggagcttgcaggactgcgtgttgctctgggtgggtcagtgagtgagtggtgagagagtgtgaaggcctaagacattactgtacactactgtagactttataaacactatatttaggctacctatatttatagaaaaatcttctttcttcaataataaattaatgttagcttactgtaactttctgacttaataaatgttttaatttttcaaaactttttgactctttttcaataatagcttgaaatacaaacacattgtacagctgtataaaaataatttctttttatcctcattctacaaacttttttgaatttttaaattttttaatataatttttaaaattttgttaaaaacaaagacacaaacacacacattagcctaggcccacacagggtcaggattgtcagtatcactgtcttccacctccacatcttgtcctactggaaggtcttcagggtaaataacaagcacgaagctgtcatctcctataacaatgccttcttctggaattcctcctgaaggacctgcctgaggctgtttcacagttaactttttttttttttaataaaaaatacatgtagaagcagtacactctaaaataacaataaaagtgcagtatagtaaatacataagcgaataacagtttttctaatcattatcaggtaatatgtactccatataattgcatgtgctagactcatacaagtggtagtgcagtaggtatgtttacgctagcatcaccgcagacacatgagtaatactgtgacattatgagggctatgatgtcactaagtgatagaaattttttagctctgttataaccttataggtccacatcatataggcaatccatcagtgaccaaaatgtcattatgtagagcatgactgtattagttcgttttcacgctgctgataaagatatacctgacactgggcaatttacaaaagaaagaggcttaatggactcacagttccgcatggctagagaggcctcacaatcatggcagaaggtggaaggcacctctcacatggcagcagacaagagaagagaacttgtgcagggaaactcccctttatgaaaccatcagatctcgtgagacttactcactatcacaagaatagcatggcaaagacccgccaccatgattcaattacctcccaccaggtgtctcccacaacacatgggaattgtgggagctacaattcaagatgagatttgggtggggacacagctaaaccatatcagtgactacagtactatagcagttgaatagttttttttaaatcccttgagtatcttatgatctataaaatggcagtcaagcctatcctgtggatatttgcaaggcttataaatattgtctggaagagaaagatgacttaggagtatattataactcttgatgtttttattatatttgtcattaatgtgcacaaattataaatgtattatcattaataataatttatttaaaaaagtgatgggatatcataaaacccttgggtgaattcaaacatggccactttgtatgacaaattacatgcttctatttctgttccacccagggtttcttttgagcagtggaaattcatctggaaacttaatgttatcccactatagagagccattcttgatgtgccactaattctgccaaataggctgacttgactactctcttaggatacagaattatatgaagaaaaatagagttgagaaggaaaaagtacaaacgttgtgtgtgcatataacaaacagatgactgctttagacatatttggtctgtaaacacctgtggaatcttgcctgtgtctctaatttttccagattttgctcatgggagagacacaatttgttctttgaatgtagccattatattttaacatacatgctgatttaatcatgctggtcaaaattttctttttatagcatccagacagcttgtgcatataactacatgcagttttattttgtggccaactggcaaccatatggaagtcagttaaaatgtattttgattatatgactctgtgcacataggcacatcatctcaggaaggctcaggtagcatagaggcaagtgaattcagcctgagattacagtaaagacatgaatctgatagtctggcatttctggactcacactgatttcttgaagaaaagcccatacagttggaatcagtgccttaaattaggtttcttaatatgatgagctcataaaatatgtgttgtcctgccttcttcagatgtgagagttgatgttacagagatctctttggtaatatgactattttaataaaatattcacaattaaaaatatatagaagaaagcagcaaggaaagactagaactaatgattagagttgttgaaaatgcatacataatttactccctttttaaaaaaaatggaactgggctattctgttgtacatagacttttgtcaaaatcaaattaagaatactttactcagttttctttttcttcctttattcatctctgtaaatatgattttaaaggcccttgaaaacaaaataattatcttattaaaatttagttacatgttgtgtttaaaatgctaaagttttggccagccgcagtggctcacgcctgtaatcccagtactttgcccgagatgggcagatcatgaggtcaggagttcaagaccagcctgaccaacatggtgaaaccctgtctctactaaaaatacaacaacaacaacaacaacaacaaattagccaggagtggtggtgcgtgcctgtaatcccagctactcaggaggctgaggcaggagtatcgcttgaacccaggaggcggaggtcgcagtgagccgagattgcgcaacagagtgtgactcagtcttaaaagaaaaaaaaaaattctgaaatttatcggagaaaacaattgggatctatttttagtctcaaatgtaggcatatacaaaaataatacatagtagttttctaagtactattagacatttgtttcccattttgccatttgctttcagtttacctgacatgaagataaaaatgatagctatttctcacttggcatttgaaagacaagagcaataagaaacccagcaaaactcctagagaattttcatggggaaaataagcatattgacattctttgacttttgtaaattgattttttggctccagctgctctaaagccattaagagttagagttaatcattcttgatttttttattgttagtcagttcccttattcataacactgaataatagcaatactactgagttttatttgtgttcacattcagtgctatgttaaaaaattcacaaagtaacatactgaaattcttgcaggtaactggtaaaatatgtagtctttagtagactgttgattgatattctagtaaaagagtaaatcttgtgaatttcagaggtggtcccaagatggtcttaaccctactgtgttaaaaaatatcagcatctttttcctataaagacaacctgaaggctcttttgaaatatgtataagtgcttctttttaaaaaacttattgatcaaatcagcttaattagctatgaaaggaatgatccttcacccctatgttaatgtctgtttacactgtgagtttgtaaaagcttctgatagagattgatgccatatctaataaattatcccactatatattcataaagtactatgattatatctatatgaatatatatataggtgaatgtagattcatatcaaaaattgaaacccagagaaaaaacttggaatttggtaggcagaaccatgaccctcctcaaagaagtcctcaccctcatccccgaaacctgtcagtatgctctgtaacatgattaagggcaattaacattgcaggtagaattaaagttactattttagtccatttgtgctgctataacaaaatgcctgagactgggtatgtataaagaacagaaatttgttttctgttctggagcctaggaagtccaagatcaaagtgccagcaggttccatcatctggtgagtactgcatcttcagaggggaggggaaaggaacagtatgttctcacctggcagaagaacaaaagagcaagctaccaaacactgccaagcctcttttatagaggccttaatcgcattcgtgagggagcagccctcatggcctaattacctcttaaaggctctatctcttaaaactactaggttggcaacacctgaatttaagagggggcataatcaaaccatattattactaatcagttgaccttaaaatagataatcctggatgatctcggtgggccccttgtaattacaagtttccttaaaagtggaagagggtgacacaagagaagtgagagtgacgtaatgcgaacaggactcaacacaccattgctgactttgaagaaggaggcctgaatttcaatagccacggaaggggacaacctttagaagctggaaatggcaaataatactacccaaaagccctcagaaaggagttcaaccctgacagtacctttattttagctctgtgcaacctgtttcagactgctgcagaaccgtaagataataaattcatgttgttttaaggcactacatttgtaataatttgtcaaggcagcaataaaaaaccaatgcagcaaaagacaataacgtctgtttaaccacacagtcacggaacatctattaactagcaacttattaaatacagcttactgctgcaacatctttggtgtaattaaaacatcctccatgaatcagagtgagaattatacttaagtgtctgccaattgccatgataatagaaaagcttatgatctctctactaagtaccttaggaagacaagggcccaatgatatgagcagtgtggtggaaccccaaacatcttcccactttcatgcacacatatcattcattctcctttttcccaaggttcgctgttagtatagaggcacaatagatcatgattagctctgggcatgttcacagtttagctgcctgagcagattaatttgagagtccaggaaaagcttattaaacagattatgagaactagacaagacttttgagaccatctgtccaaaactttggttttaccagtaagcaaattcagacccagcatcactcagctggtaggtggtaaaactgagaagagaatccatgtattttgttttttcctagttctgtgttgttgcactgcataatgaattccagccagaaccacacattcagttcctgactagtccacaattagaatcaccatcaagtcaaacacaagtgaggcattacatccaggaggtcatagttagttgtgtgtgtgttccctagatagattccctgaagctttctcatcaacaccaagaagctgaaggggaaaatgaaagttccccttcagttcccctcaattcaagagtaattgagaccaacatcattcatggatattaataatatgaccttttttaaagaatcaccaaatcattacatcataaagaacaatgatcttatattttactaggtttattagttgcagtctcagcctctaggttgctagaaagctctgggctcctttggatatggacatggccaaatctctttaactttctagttatggcactttaggcaaattcaacttctctgagtctaggttttctcctctgttcaatggaactgacaattctatgtcagagagctattgtaaggattaaaggaactaatatttgcaaaccccatactgttgcttggaataaaacaggtgctgaataaatggtagctatttgattgttagttttaaaaaatcttgctagaaatcattaagagtgtatttatctaagtgggggaaaagaaaaacctaagtaagacccttggatcttgaaagaaagaaaaagagagaaatgattgtcaacacaaacagaaatgcttgaggaacttcaagggctcaagagtcaaaggacaggctagaaaaaaatgtcagagaagaaagagctaagagaagaaagtcaaaggaaaggagagaaggggagaatggaaggagaactgagaaaccagcagtgtttttttaaaggtgataactgaagaaggtgagcagaggaagaaagaacacagtgagtaattgaaatcaccagttattttcttctgattcatctcttaaaggaaataccttctaagagagatctttgctcttttgtgtgctggtgaatgtaaggtgagaatctctcctttctttttctaatgatgaccctgaacaaggccgtgctcttcttttaaacatctcttctgtttgaagctctgttacaatagaatcaaatagggtctccttggtttatgtcactgatctaaggttgaatgatgtacttgacagatccttttgaactgccccatctgggaactgaaccaaagactggatcgccagtcatggtactcacaattacctttccctttccgcacagtccccacattcactacccgaaagtataaaatccatctcataagatgcagatgaagtagaatgatgcggtttcccaaacttgcctgattatacaaaagcccagaagcattgctgtctggagattcggattcttacctcaaggtgattcttatcattagaaagtgaaaggtacagaaatgaagaaactttcgagtaagcaacgtttcctaccaagggactgggtggttctgaatataacaccatctttctcctaacaatagaaggtgacattttgacaaataagcttaggattcgtattcttccctaaggtatcattttgctgagctatcattttttttctttctttttatttttgagacagagtctcactctgtcacccaggctggagtgccgcggtgtgctcttggctcactgcaacctctgcctcccgggttcaagcaattttcgttcctcagcttccagagttgctgggattacaggggcccgccagagtttctggctaatttttgtatttttagtagagacggggtttcactatgttggccaggctggtctcaaactcctgacctcaagtgatgagcttaccttggcctcccaaagtgctgggattacaggcatgagccactgctcccggacttgctgtaagctatctttttgccactcatgatgatgattgtatggatgactctctggtctgtgttgtcagtattcaagtggtacctccactctgtcacatcttcattttgcttgtctagcagacttgctagtcccttctgtcttgttccatgtcaggcttggacatatgaattgcaatcacattgtgagacaattaattgtccaatatttctcaagactccctgtcctttagaaactattttgcattcatctttgagtcctcagtattttgcctagtaaacagggtttgtcaagtgaatatccaatatagactcaggaagatccacatggggagtgagaaaattgagcgaatcccaggaaaagaacaggaaatggaggtaaaagactcacgtaagtttacccttctatccaggcatgcctccagacaccagcttccacttccttatctgtctggaattggtgttgaattgatcttcgaggtcagtttgaggtttcttactctctatatgagtctctgatacttagaatgttattttgtgctcagattgccagaaatcatgaagaaatgaaaggggaaaaatggtggcaataatgatgactaacaatgttttattgtgtgacatgaagttaaacagtaataatttattgttatattgaatgctgcagcattaaactgctgcctccagtgttaaaagcaatgctcacaagacagatcttatgagaaactctatgtaacagcaaaggatcactgaaatattcagatacagaatttacaatagttgcattagggcttcctttgaattaattaatatttcctctgagatgactcctgccaagtggttttgcttcattcctgatttaattgctaggaaaatcagaattattccagaaagtgaggctatgaaggtttcattgtaggaaaatcttgtgtctgaagccgtgaggctggacaaagggaaatgagttgaatgctgttgtgaatgggcagaagtcagcaccagcaacttccattcatttcgaagtaagagttgataagagaattgactgttgaagtcaaatctccgtatattttcttatttccttctttgcatccatcttgcaaagcaaatttttaagagaaaacgagtgtttcattcttgatagtgaattgctctgcttcttcagcaggaggtgcaggagaaatcctatttgcatcctttccactgctcttaacaagcccctaaaggctgagttaatgtttatttgtggcctggagtggccaaaagggaatagcaggaattattttcttcatagaagtggtggagaatatgagtgcctccctctataaactggagaagatttacctgcacaattctcctctctgctttttagtactgcttgggggatgaaagggacccatggactttggcctcagacacaccaggctggtttcaaattttccttttttctgaaatccacagtaagccacttaaactctctaagccacagtattctgttctgtacaattggaataacaatgctgtgtactggaacagcttcataatttgtaggcccagtactaaatgaaaattgggacccttttgttcaaagaacatgaacttcaagacagtaatggcagagcatcaaataggtgtgtggcccttctgagcatgggggctgtaccactgggcaggccacataccacgaagttgacctcactgtgcagctggattggctgttggatgtcagatatctttccctttgtatctctgtatctcagagagtggatccctgaaaatggcatttgcactggctgctagctagatttagccatggaaggcagtagtaggagactgatggtgagaggcacggggaagccaagttatttccctcttttctcctttcccctgtctctatttccctttgaaacgtatctccaatagtaactgctctcctctttcagttccagcatacctaggacagcccaccttctggggtcccacctttcctgatcccactcactgctagtcagttctctgcaggcagcccagctcctcatgctctaaaaccaccatttccttggttcctccagcctgacaggtgctagctgcttcctgatataactaatatcttgactacctccctgttccctatgaggcatttcagctcttccaagcctctttaactagttccccttattaactattctttattcttcatagaatctgatataagtgtctaccttgaaaggttattacaaggaacaaatttgtctaaggcagtggttttaactgtacattgcaattcatttgtgagtaatacaatcagtttgatgggtcaagaccggtagtttagaacacaaaataacttagagcagaataagaaaacatggtagtgcattgtatgtattaaggtacatatgatttaataaagcttttagttgtctctgtgtgtatgtgtgatgtgtaccatttcatgctgtaaaaatgtattactttctagcaggtgggagaaggaaagaaaggccaatggtctaagacttctggtacataattagcactcaataaattgtagaaactattgttgccatccaagaccatgccatttaaacaaaaggcagtcagacagcccaaagagtttaccattccaactcactttagctcattagaatagtttcatgtagttgggccaacttgtactaaaatggccaaagcgtttacttacatttgtttgtttacacctagacaggcccagcttgagtcaccagccttggctgaaagagaagccagccaggttcaaagtaaagaaacagttttaaaataacattttatttttctgtgagtcatagcaaatctgtccctgcaacatctttctcctgcagctaaatgctttaaaatggtcaggtctcacccaggaaagtgggactgggaggaagtgatgcgataaaacagcttcccaatcagtgcattagtaggagtgcaacctctggcattcctcttttttcagaagtatcaaaaagctctgcagagataactgtgtctccagatggccatgagattggtaaatgacaaatgtttatcagcctttcagcacctgctgatggaagaactaaaaaaaaaatcgcaagtgactttatgagcccacagccaccccagctgtaatgggtgctagtagctctgtgttgctgacctcacatgggtaaaggaagagcagaagaatttttagtcccttggctacttcttatctatttcatcaggtaaggaaactcaacttgaatcctttcaactctgaagaatggtagatctgaggaacaacaaagagctataggtcatgtggatttctctgctcagtcagagagcccagaactctccctggagctgaagatagcccttgcaagctatctcatgatggttttatagcacagtgggctcactcatactggtgctggttttgagcatctatgttgacaagacaaatgtctgtttctactactgcagaggatagagtttaaccaaagtcaggtgacagagaaaaagaacagaaactgataacacttacacagtatccttatatagcaggctcttgaataatgcaggcattggggtgacaaccacccttacagtcaaaaatctgtttataacttttttttttttcagatggagtcttgctctgttgcccaggctggagtgcagtggcatgatcttcgctcactgcaacctttgcctcccgggttaaagagattctcctgcctcagcctcccaagtagctggaattacaggcatataccaccatgcctggctaaattttgtatttttagcagagatggagtttcatcacgttggccaggctgatctcaaactcctgacttcaggtgatccacccgcctcagcctccccagctgtgtagataacttttgacgccccacagccttaactattaatagcctatcattgactagaaatcttactgataacagtcttttaatgcatatgttatatatatacattacactatattattacaataaagttggaaaataaaatgttattaagaaaatcacaaaaaaagagaaaatatatttactattcattaagaagtggaaattgatcatcataaagtcttcctcgttgtcattgtcttcaggttgagtagctgaggaggaggaggaagggaatgggttagtcttgctgtctcaaggatggcaaaggcagaaggaaatccgcatgtaagtggacccacgcagttcaaacctgtgttgttcaagggtactttatgttgtccgggatgctatattgagtactttatacatataaatttacttaatcctcacaacatgcctacaaggtggatactactattgtcctcatttccagctgagaaaacagatagagaaggcaaataatgtgctcaaatctgcacagttaattaatcatagagcccaaattcaaacaaaatagtgtggctgccaagtcaatgctcttgacctctacccagactgggagccagagggtttgcattctaattttatcattaaccaatctgactgatggggcaaatcaaccctactgcaatctcctcttttcatctgtaatataaggttattgcttgagatattttcaagtcttagtgccacctcccatttagagctttagtgttgagaaagatgatattaatgtattccgttgtcctaaatatttcaaacacgtcagtttctacttttccagacaactccaatggggatatttttttattcctccacttcctaattaaggctgaaagggccccatattcagctgctgagtctctgtctcccgccttcttttcctcctgtacgacctaaaactgtcttttgtctttcagcacttggggagaaactctgggaagctttctaaatccctaaatttgtcacacccatccttaaagcagtgctgaattaaaaagtgggattcgtctaagcagaggagatacttaaggaaggagaggggctacagcactaaatgatgtttccaattaagagaagtgtaaggtcagagagaaactccctcctggatggagctcttcaccacctgatgagctgattaaatatcatgccgcaaaaagtaaatgtttactccaagccaggtgcttggactctaaagaactctattaggcaagagtaagtggtttaattggctcaccttcattcaactgttagtatgttcctcataagtgcctgtcagagagaatcttttgtgtttcccttctaacagctggctcataaaaacataaactcatcttacaatgttaagtaaggatcttttaattcctgttttctttcctccaatttgtattaatatgataggagagaaagaaagtgaaagcatgcttctatagctggctacttcatcaaacttaatggaaccatattttgtaattcattctataatttaagttttggtcattttatctcttaaagatgaattccaggccaggtgcagtggtttgtgcctgtaatctcaacccttgagaagccgaggtaggatgattgttagagcccaggagtttgaaaccaaccaatatagagaccctgtctctacaaaaaaaaaaaaaaaaaaaaaaaagtcaggtgtgatggtatatgcctgtagtcctagctactcaggaggctgaagtgggaggattgcttgagcccaggaggtccaggttgcagagagccatgatgatgccattgcactccagcctaggcaacagagcgagacactgtctcaaaagacacacaaacaaaaaaatatgaaaccctagctaaacactgtggactcaaaataacctgtgaaatcacccaaccgtagtatttatctatgagaatgtttcaaagggagatatgtagttgtatgactatttcacgcagatatttgttattaataaaagactttgtggtcagcatgacgtgttagctacagttgaatccatgcttctttacattttgtggtttggttgttgtcgaatttactttccatgcattatttccaaatatatacttattatttcatcagcttagaatggtttggatagaaaaatatatcaaggtctcagaaatgccccccattaacataagggtagccatgacttgaacccaccccactggtttcctttgtctttctccatttctgattctctttctctgtggttacctaggatatataaattacttgactttgaaattcatgattaactcagaaagttatagctagtgattcacaatatttgttttaaaaacagtatgaagaatgtagaagcttggtttttaattataataatataaattagtatcattttatgtactcaaatgccacacacatatgtataaggcattcctatggaataatcttaacctggttctttgacaatttttgtaattcattctctagtgaaatatttccccaaagtgtatccacagattactatctcaccaatatgcttccggaaaaaaagtgccatggtctaataagtttaggaaaccttgcacattctttttccttgggatcaatcattagtattagcagatttagcactaagaaatcctgtagtagagaaattcatttacttttaattcagtatttctcaaaatcattttaccctattactcaaatccctgcttttattctgggaattgttacctctcctttcctttgcatacacttgagaaattgactctagaaatactagccttatgaaatattgatagtaattgctatggtttgttagactcctccaaatctcttgttgaactttgatccctagcattggaggtgggcttaatgggaggtgtttgggtcatgagggcagatccttcatgaatacattaatgccctccctggggtgggtaggaactgagtgacttgttgctctattagtttctgtgagagttgtcccccgactcgccgcagagctggttgttaaaaagagcctggttcctcttccccctctctctcttgcttcctctctctccatgtgatctctgcacacaccagctccccttcaccttctaccatgagtgcaaacagcctgaggccctcacagatgcagatgccagatcattgcttcttacacattgtgtagaaccatgagccaaataaacgtcttttctttataagtaactgagcctcaggtattcttttatagcaatacaaatggacgaagacagtactgattatttgttgggcatttcctatgtgcgaggaactgttacaggtattttggcagttgtaatagcgaggtatttattttggtgctttaacagagactaaaatggctgctttaaataagattgattatttctctctcacatgaaagcctaaaatggtgagcagtgtagcaacttagggcagcaatctttgggtcatccaaggcatcagataccttctgtggtgttgtttcaccgtcctttgaagtgttcctttcttcataggttgaaaccagctccttgtacctcatctggtcccatccctaagaaaagagaccaaagagccatccttgagaaaagagaccaaagagacatccctgagaaaagagaaaataaagggcaaacagcttcttgttaagaatctggtctggattatgctcatagctcattgtccaactgaataaattgctcaatttattgagctcataaattgctcaatatgacatggccatacccagcttacaaggaagtccaagaaatagtctcttattggggaacatttgctctcctgaaacatagaaggttctattatttaataggtagaaggaaagaatgagtattacaaggcaattagctttctctgctgtgtttttacctcattaaatcctacctacaacccatgaaatcagtactttgtcttcattttaatatgagaaaactaagatacagagaaagtaaaactaaagtcacgtagcgactattcgcttttggttttgataccatgctacctaattccatagcctgggttcttagctgatacacacagttgcaatgcctttccagaaaatttctagtagtttccaccattcctggacctattcttttctaactttaaaggcaatccatcttctaagtcagtgtggcagagactctagtttcttcacccaaaccatgttctcctgtctttcttgggctcatgtttaaactatatttctcatcttctcttaggtattaccatatgactaaggtctagtaaatgcaatgtgagaagatctgttgtataccacctccaggcttggcctgtaaaaacttcccatggacatgagctcctccatgccctttcccctccagctagatgaattggaaatgacacccaggacaactggaaggccatatgtcaaaatggacaaggcttgctcaccctgaattctagaataattttgtggaggagaactaccctaacaatctgttttcccacctagcaaaaaaaaatgtgaccacaaaaataaacttctgctgtgtttgatccatttgaaagtttttgatctattagttctagcagttagcttcctctaaaaaatacaattgattaccatgatgtcatggataacaagttggcaacctgggtcaaagtcctattcttgtttttttctagtgataagaccttgggcaatttattaaatctctccaagtctcagttttctcagctttaaaataatcttcaatcatagtgttgttctaagaagtaaattagtttatcttaaaaatcctattccctgttaattattccattctagcaatcaatttgtgcttattctagttgtcccactgtttaaaacacacatgccttagtattatgaaaacatttcaaaagaaatatgtcttagatttctacatttatattagaaaactttcaaatttatacttcatgccttttaaaaaaataatactagtaaaatgaaagaatatcagttttggaatcattccacagtcctggataaaaatacctgttagaccacttactagtggtatcatctatgtgagactcaaattcagcatcagtaattttggaagaatggtagtcctactttcagaattgttaggattaaataaagtgctaaaagtctgtgaaatctccttgcacactgatgatttcccttctctccccaaatagatttccatatggagcacttttagtcatttttgctggactgcaatcacctttctttcttcaaatgttaaaactgaacagtagtagctagcaatttggaatctctagaaagaagttttttttattattatagtgctgaagctcagctcattctctcaaggagcctatggatttggagtgcatcataagggaagaagttaacctcctgctgtattaccagagaccaaggacaaatgttggttgtcacctgcctaaccaggcaagtgatagtcacagactgtccatctcacaacaaaacaatgctaattttgttgagggatagaaatgttgtagttgatctcattttctctagcacagtgtccctttttgaatgttccttctcaaatagggcatggtataaactctgcaagaggggagttccatttggaagacatgtaggcaaacaacattcaggctccacacccacttcgcctgctgagatttgacttattacacaactgcagatgctggtcaattagtttctcatactcattcgtatcacagaagggatgcagtggttataaattgcactgattatgcacaccttggcttaccctattgttgcataaaaataggcaaggcatgttagtcattgcatagtcttttcagtagaaaggaaaagtgattgagaaacagcaaggaaaattgtgtttacagctaaggtttttgttttgttttgttttgtttccactccgttcagtgtgtatataaagttaatgcatttttaacttaacagcaaccaacaacagcttcactttgagtgcatgaaaaacactggggcttaagtgttgatttgttgccaggcatttcctttgggaatccatgtaggctgatcatttacctgggaaatcgtgtgtgtgtgtgtgtgtgtgtgtgttacctttacctttgtaagggacatcataaaacctcaatttcctggtgtgttccagttaattttctgctttattgaatgtcactctgaattccctatttcctttaacttttgtgttgaaaaatcattcaaaagactactgagccattttcttcttcattaagaaaaatattgggttagacttaattcttgatagctgaaaattttggagcattgttttgtttgtttgttttacatttttgaaacaaactattttgagaccgtaataagaacaatggataatcttcccagaaatcagagagagaaagagagagaattctgcataaatttatagatccttgcagcccacatttgaggccccagcaatagaccccaggttaagaattcctgccatagagtgttttgacattatcattctaaatatttaattttgtccaaataaaaatatagacagagaaaagggaacttagcaaaaatcttcatttacattcaaaacaattcaaggtgcattaaaatcatgaaaaactttgttcctctataggccagggaagtttcttgctacttatttcctttattaaagtatattttattgatttgtctttttcttttaaaaacagaatatccaatgggtaagactgaccaaagatttggggaagttgattctaaataggtgagctgtgttttaagagttcttcttagtactcttcaactcagcatgtggaaataaatttcaaaagcttttcttaatttcacaaaaacaaatataaatagttatggggggaaataaacaacaggccaaataccagatggcaactcaaagcacattgtctgctctcttgctctaagctactggttctcagtaggggtgggacagctcccaaaagggggtctttgggaatttgtggtgggtttttggtagtcacaatgttaagaggtactataatagctatttagatggcagagttaggatttcctgtttctttttctttttggtatccctcatgactatatagtctccccaatatattcacatgggtgaaaatcctattcgtaatgattgaactcaattataactccatttacagataaacatgcacaaaattttcatggttttaatacactgaattttccaagggtgtgtgaaattgctgtacatattgacagaagattgttgtttgatttggttaagaactttttattattattattattattattatactttaagttttagggtacatgtgcacaatgtgcaggttacttacatatgtatacatgtgccatgctggtgtgctgcacccattaactcgtcatttagcattaggtatatctcccaatgctatccctccccgctccccccaccccacaacagtccccagagtgtgatgttccccttcctgtgtccatgtgttctcattgttcaattcccacctgtgagtgagaacacacggtgtttggttttttgtctttgcgatagtttactgagaatgatgatttccattttcatccatgtccctacaaaggacataaggaaatgtggcacatatacaccatggaatactatgcagccgtaaaaaatgaagaacttttttaagagttatttttcactttagaaaatcagctagagaccacaatgctgtttatggtattgaagtccccatgagaatgcacctggatcagtgtacatttgtaatgatcagattcacagtgattccatgtgtaggtataagcttttctctacttcaccatgtgtccttgtatagttattgataggggttggctgtggccccctcccaaatctcatcttgaactgtagctctcataattcccatttgtcatgggagggacccaatgggaagtaattgaatcatgggagcaggtctttcccctgctgttctcatgatagtaagtctcatgagatctgatgattttataaaggggagttcccctacacaagttctctcttgcctgccaccatgtaagatgtgactttgctcctcatttgccttctgccatgaatttgaggcctccccagccatgtagaactgtgagtcaattaaacctctttcctttataaattacccagtcttgggtatgtcttcattagcagcgtgagaacagactataacagttatcctgcatcttaacatatttcaatattatttattatatacttatatataataatataaaaatattcattgtgcatttatatatcataatatatatattatgtaatttttcattctgtcttataatttattctaaaaattatatttttaagttaatttataacttattaagtcagtgtttctttaggaaatgtgccctccgtcaaaattttattctttttggtctctttgctagtatgctactagctaaagaaaattcattcccactaattctggattcttatagttattcacagccatgctgttaaagagacaagtgaattactaccttctcagagttgaactcaagggggaagtttgactattggctggcaaaataaagtagtggaaatttatttcttttgttctcaataaaataacctgtgaaccatcctaaaactaaaaaaaggaaattatttatgaagagaagttgtatcatttaaattcgttttctctcttttccctttatttcagaaaccttccataataaaaacttggatataatgaaattttgcataaatgacatgtgacaacctaatttagtggaagccagggaacctgctaatactttaacttcaaagctcttccattttattccttcattacttttcctcctttcaaagcattctttagccatgcaccaagttcgaacaatgacgaatcaaatcctcagagccaagaacaatgttctaatatttccatgcaattaattgctacttcttggtgagcatccagtatacttgattctctcatagaagattctccaagcctgacactcggttgaagtctgaggacttcactgaggacaaagagggatcaaatcttcccaacaaacagtgaactcaccatgcaaagtgaatagaatcccctaatcaataaatcactaaatatttatggagccccgaaatcatattgtgacaagatttttcaaaaaaaaatgtagaaactaagttatgatacaatcacatgtcaggaaggtatattggagtactacttgtccaggactccactgacacccccttgtgctccctatgtcattttgatgtaccaggccattcactgtatctataacgtgaatttttgcccctattttcaatgtcccccatcctattagcttttcctttccagtaaacttctccaaacccttcctcagtgtttcaaaggcaacaaaagttatcacaacaaaagtaactagtatttcttgagtgttcacagtgggctggacaagcaaagtgctttacctgcattgcctcagttaattctcttaataacctatgacatcagctctattattaacctcattatacacatgggaaaatagacactactatgggctgaatatgccccctccaaaattatgttgaaactaaatccccattttgcagtattaagaggcagggcctttttgagtggccagccttcatgagtggattagggccttatgaaggggctggagaaaactaacttaggccctttttgcctttctatcttccaacatgtgaggacatagcatttgcaccttctaccatgtgagaacacagcaagaaggccctcaccagacaccaaatgtgctggtgccttgatctttgacttcttagtctcagaactgtgagaagtaaatgtatattatttgtagttacccagtctatggtattgtgttatagcaacatgaagccagacagaaaaatttacagttttcatcacttggcagaggtcacataacaggtcgatttgattctcaagccgtctttactattatgcttacttggcttttatctctgtagactttaattgctgagttatctttccctgagtcattgctgcttcaaatctcagtctttaggaatcacttctgtaatctgctgattaattatgcatagatcataaaagttatttaatccagctgctgtccagagtcaatatcactatcctactcaaaaatctgcaacaatctaccacgaaaaatcaattctaaactccttagtctgacattaaacagcctgataatctgatccaatccagcctctctgcttctacctatcttgtttacctgtttgttgattcttattcaattgcttccttgatggaggactttcccacccactccatcactacctcttgtttctgcctgcacacatcatttccccaagtcttttgataagaaagatctcctttttacaactatttctctgctctctcctctccaacatatcttcctgacatgtgattgtatcataacttagtttctacatttttttgaaaaaccttgtcacaatatgattttggggctccataaatattttgtgatttattgagtaggggattctattcagtttgcatgtggagttcactgtttgttgggaagatgtgatccctcttttctctatgcttccatcatgacctggatatacttctagtatggccctttctaattcttcacatgcatgccttcactggactgcagactccaagacaggggccatgcagtattcatctttgtgtctttccagttactccacaacaatttattgagtgaataaagaaaatgctgagaaacgaactcaagaggttttgtagatttaataccattgctctgggtatcgcaaaagataatggctattaatgaattagtaccccacttcccaccacctcaccctgttgacatagtatgatagaatgtgtaaccacttaatctaccttaagatgctattgggcaacaacaatgtcttgactttaggggctggaaagcaaatagtatataatgtccaattgctcttgtttggggcagagagcacagatttaagaaacaaggatacaataaaatgaaatttggctgcagtacaaggttaatgtctctcctcacctcccaaagagtaccaagggatcattcattgtcacagctgttggggtttagagctctcttctcatccaaatgccagtactttccacaaaaagctcttccccagggatgccctaataagccagtgtgtcctgtataggtgagacttgccctggctgtctctatccaagtggtgacataagctcatctaaagcctttcattaatgcaaacaatgacccagcccatggtggcactgattcttgaagctgaagacttggagaaggagcctgattttccatcacactgattgttgttttcagtaagatgtttagcttttcaattttctctctgccaaatacaaattagtgtatttccaacatcccagagtcttagctgtgcattgccagcttccactgcttctccttaattaacaaacagctgtagaagagcttctcaactgacatggggggaagagctctaaggaagatatggactatgtctcatatcttcaaatcctccacagtcatctcctgttagatcaccaagaagaaatgcccagtggagacacttcagttcaatgaaaagtttatgactagttgggtttggtctccattttgtattaatgtagttgggttcagtctccaatctgtatgtatgtagtttcctatcccagagagcaggacaagaccatataagctctatttatgtttcctttgactctttagctgaaagcctaggatgtaggacaagtggctaacctgttttagaactttcttcctaggctaacattctgaacttggccttgtggattttacctcttaaactgcaccaaaaaccatggaaacaaagggcttacagcagtgttagcctaatctgagccctctataccttcctatactgtggccacagcagtaaagctacgtggtcttgcaaaagaccttccaagagaaggttggctacagaccttgcttatcacaccatgaacctgaggaggaaagaaaatactcacaaatagtttagcccctttcataaattgttggtccttaatccatttttgaaccctactctgttgggtggaatgtgtgtgtatctgcacgtgtgtgtgtgtgtgtgtgtgtgtgtgtgtttagaaattcaaaaaaaatgaggagatcttggtcttccatagagggaagactgcattatcaatagagtctttcttagcagaggatgaaggctcctgtagctcctaatcttcccatttgtgcacaaatacgtgaattctgattaggttgaaatcaggaagacactcttttgctgcttagtggccacatctagagctaacaacattatcagtgggatggtgattcatggtttaagaacataccctcgccattccagctactcgggaagctgaggtaaaaggatcgcttgagcccagagtttaaggctgtagtgtgccatggtaacacataactagccactgtactctagcctgagcaacatagttagaccccatttcttaaaaacaaaacaaaaacatccttctcctcttctcctcccccagcaattctggatggctcatctaataaagtacatatattttacctaatctagtcaaatgtaatgacacaataagattattattattctccaatccctgctctgcaacatatttggctgaacatttttggctgcaacatttttggctgaagagaatgaggtttcttcctccctgaacctgggaactaacatgaggtgttttcttccacttggtggagctgtgcacatgtgtgcttgcggagaaaaagaagagtcccagcaggccctctactccagctgttggagattgagctttccagtgcattatcctggctttatgcagtgatgccttccccctgatggcagtaaaattttaattagagggcaatgtgcattcctatataatggagtgcacacatggcaggaagttaacaggacacgtttgcagttccagtttcattgtcaaccagctgtgtgattcctggcaatttgctttattttgttgtgtcacagttcttgactaggtaaactggagagtcatctctggtctactttcctcttcagtttggtggaagtttcacgtaaaattacatgtgaaagtccttgagaattgaaacaatgggcaaatctatagcagaatgcttgttgaattctatcagctttcccaaggtgcaggctgcccatgtttagtctttctcactttccaatccattttccacactgcagccagcgtgttttttctcaatggaaatctgatcatatcaacctcttttttaaaaaaaatcctaaatatcttctccctctcacagaataaaaatcacaattccttaagaaactgtcaaagccttctcaatctgtgcctttcatctctgaccattggtatctttcttctgataggataaaagttcattgaatgttcaagccttctcttttgcttttcagagcttggccatgtggttttctctgtctgaaacaagcttcccccattcctttctaggctaactcctactcatcctccaaatttcagcacaaagtcacttacagtgggaatgcttccatggccctctattagcagcctctgatttatgctcccacaatagtcggttctgcctctggaccatgttttatcctattgtttttcctccataagagcacagtcataatctgtataactcagtgttgtaactctggcagctagcacaatctcaggttcataaaaagagctcaagaaatatttgttgaatgaccaattagatggcatattcatttcctagggctcctataactaacgctagcgtggtgccttagaacaacagaaatttatcctgtcgtacttctagagggtgggggtctgaaatcaaggtgttgtcagggctgtgcttcctctcagattctacacagaatcttcccttgcttctttggtggcgatcagtcctttgcatgctgtggcttgctgctacatcactctaatctctgcctttgttgtcatatagcattcctcctgcatgtctctctttgcacatggcattttcctcttataaggaaaccaatcacattggattagagcctatcctaatggcctcatcttaacttgattacatctgcaaagactctatttccaaataacgctacattcacagatactggaggttaggactttaacatatcttttggaggaggatacaggtcaataacagattgctaaaccaattaactaattactaattaatataaattatgggtggaaaaagcttccccagatcacgataaaaagctgtgtcgatctaatcaacgtgcttgcttaaataaggcatgtgtataatatatatgcatgcatctgtgtatatatacatatgtacacatgcattaattatgttgtgcaaaaaccccaaaggctatttatcccaaatagaaaatattgtgtcgtttgtctaaagcactttaaagacatctgcctttttcatatgtaaatttcttggatgacaagaaattactgctttgctagcttttaaaacactaaattatgataatccatcaccaaataaactataagcttctatcatttaaaaaatgtaagaactctgaggttagtagtagtttttagttgccattgaaagacggcagtttaacgtcatcgtttattcagatttccaaattaaggagatctctgtggttagacattcctttcgttatcactctccttttcttcaggcctgtcatttgtccattgatgtcttttccttccaaatgattcatgtacacattaggtcttttccctaagcctcatattatgaaaagcaaagctacatgaaaaaaagcaaatgattgctaaattatgtcctaatttctagcattcagcagtgctaaaatgaagcagagaatttcacaaaattctcagataaagtatatttttaccaactaacattgggtaaaagggactgagatagagatttatttttattattattaataactttgaaaatggtgcatttgggaaactacttactaatgttcattggaattggtggtaatactgaggtcaggatttaattccaggcattacccaaaaagtccatgtttgccttgtttcaagcctagagttcttaaaacaatccctgcaaggaaccaggcataaattatctttcagattggtgggcgtaggaatctatactgcgagctaactgtgctgaaatagacattttagaggatgtgaatgtctatctcagacaaaggagattacaggttattaaccaaggcacttttcaaatgccatccctttgggctttcttacttagagtttcagattcatttagccaaataccagccttatcccttccctaattttcctaaatatttgtggctgaatatacttttagctttaggagtgcagaagactttgagggaaagaaggcagggttgaaaaaggatgagtttcaggtcattacattgcttcaaggcagtttgcagcttgcattcatatttttaaagtctaaattagagccctttaacaccaactatcttgggcacacatgtatgtagaagcataccaccatatggcaaaaggcagagttgctaaaactataaataacaaagaggaaggttaattagcaaattaattagctgaattctatacaaggtactaacaataccttaatttccagatacatttgttatcaaaaatgtctaccttaataaagctgtggggacttactaagtgtatttgctgggcatggttcccagttatgaaatattaataccttgaaaaataaaacatgcttatgaaaatgcagttatgctctcattttcagaggaatatgtaagtgaggaataatatagaaatcctaaaacaactggaaattcagactaaaatgaagtagactgtagttttgtcattgcatgttctgctcatactaaagcacctatcctcccactttaccttctttaaactgcagggcagagagttatatttttcatcttcatgttgagtagagaatccatgaaaatctaatacccagttatcactcaagtgtgacaaatagaaaggagcttcagaataggatcttcagttctaccaaatgtctctgcctaattacatcaatatccatgttgatgagtgtacaaacctgtggctaattatattttcacttcttctaagggtaggtacactaatgtgtgatcccacagaaaagggcatgaaagtaaattaaaggtgtgtgccatgtatattaatgcctttgtggttattattgctattgtcttactcccatggatattggaggattgttgataagacacttaaatgttgataaggcacctaatgagtatcctgtgtgataggagtagtacacaatgataatcatttccttctttgtgcattagtattgacatagccactaatcaggaactgtaaactctaaacttgtatctgcagccctcttattaaaaagattcctggatttttttccctaagctagaaacagacagacaaacaaaaacaatgattaaagggcactaaaagatatatttaaaggcagaggtttttttcctatgtgtataagattcaaattaaattcctctttttggctatttggacagttttggcaattgggctgaagccactatgtttttgtcataacaggtcaaggattgcttactcatgtttgagaagcaataatgatatggcaagagagaggtaagggactacaatgggaggcttattaggaattgtgcatgcctctttcatgtgtgttgtctccaagctaaccttgtgaggtacgaattatgacttcttcctgaaggagaaaagcaagttttagattaagtgcctgacattctgatgtcataaaaagactgaaataagcaacattttagcacaacatttgaacagcccttttcttaaggataagctctttgctctacaccatactaatttccaaaaaggtgtgagattgacatatgaaacttgtacgtttatataaatgtgaatgcagcaagccagagaacagaatgttctgtagcccaggcaagaggcagaggaaatacccagtgacagatctacttggccctcgactaaaggggcgctgtaactttaaaatactaataaatatttagcttggctttttctttcctatttgctaagtcctgtcttgattctctggctaaggggtgtaagaaagtggctgtttgtgataaatagttgtgtttgtgtgtgaatgcatggaagaacacatctgagataatatagtgtttactgctttgccattagcacaatgggctgtctttacagaatatgatgtttaaatctatgcaccagtgcactttcaaatagagaattcgcttcctgttttcacttaaaactctctttttattttaattaacgaaaaagcagtttaatcatccatctttgcagctaaggaagttttacaggcttataatactgtcagattctgcggtatataaatgagaaatagacacttttggggaagaaattggccagtcttccttccttccttcctttcttcctttcttctttccttcccactcctcccccctttccccccactctctctctctttcttcctatgaagagactgttctaaaagctaggaagtttcattgatggtgtgtgatttcacaagctggattttatttcagaacacctgtcaaattcagagctgtctgaagcttctccaacatcattaccccagggctcccagttctatgcacatgtttttataatggcaggaaaaagaattcatatacgcatttgtgtgttagaatcagtggtgtgctggtgtaacaatcagctcctagagggtgaggcagggtgggtaggggatgtttagaaaaagtgggtatggagaagtccctgaattctagtttttgccaaattctgtgatgcaaatactcccaccacagccaatttcaaggttatttttcccagttacatttaatcagggccatacaagatgttacaagaaagaaaatgacaggaacccatgtggttcaactgatactcactcaggagctgagatagcatttcatttatgcaattcaaatagctattggtttggataccttagtattgtttcttccaagaaatattttcattctttcctaaagggataataatagacattcatgacctaatttaggagataatcattttttattttatcactcattattaatgcttcatacgaaaactagatttatgaaaaggcccatggattttacatctattatatcatctcctgttggtttgagaatgaaatgtttgttttgctaatatgtttttctgattaagaagtggaggcagcaggctattaaaagtttttctcaaggcagtaaattggtagactagatatcttcaaattaaaaagtagtgatttcttaggcctgttcatagattattcaaaaatgggttaaagcacaggttgaaaatacttttatgggccacaggataatttaagtgattatttttcagccacttttttttggaaaacatatattagctaatgtctgtaactttattaacttaaaaacaaaagtccagataaaagaattttacactctgccaagcagtggtgcccagcttataggtggttggttctgcatcttacattttgttacttgtaaggtctatgaagaaaggactcccttttctgccctgctcactgtcaaaatttcagtctctacagcatgaagactctacatatagaagacactaaaattttttttaaatatatgaatgaagcagttaatttaaggcagcaaagtcacgcctatacattatttctgtaatgtttaattttaagtataattgcttattaagtagataggatgcttagaaactatatttacctggaagtggcttaaaaatttccctatagacaaaaaatataatttgaagtagttcgtcttcaaaataaaggcctccagatggccagatacctttcatgtacatgcatcaattagactgtaccagaagataataaaaagaatcctattgttttaattatctcttttattctccaaggaacccctattcctgccaattcttacagacgttattaaggcattcagttagtttttcattcatttatttaaaaaatatttatcatgccaagtactatttaaatggtggagataccaaagtgaatgagatacatacaaggggccctagttctcaaggagctcacattcatgagaaattaagttcacacatgcaagatataccagatattaataagtattactcagatcattaaactagaatgaggccaggcacagtggctcatggctgtaatcctagtgccttttagaggctaaggtgggaggatagcttgagcccaggagttccaggatacagtgagctatgatcactccactgcactccagcctgggtgatagagtgagaccctgtctctaaagaaacaaacaaacaaaaagtagaaagatttgacctgagaataactagatagctattttagatcaggtattcatgaataaaataacacttaaagtgagatctgaatgacagaaagaaaagccatgcaaaaatcaaggagtagggtgtgcagatttcacagatggcaaatacctaacatggtgatgctaaagtcagcatgaacctccttctgtttcttgaacagaccacaggctggagaagaaaaggtaggaagaaggctggtataagatgagggtgaagagagaaccaaggccagatcatgggagctttatagccaggctaaggtgtttatgtttaattctaaatatagcagaatacattggagaagactatgctgaggaataatgtgacttgacttaaatttttaaaagactacctaactgtgtatggaaaatgaattgcatgggacaaggatggaaactagttgggagatgagttagaagattattataggagtccttgtgggaagtgttggtgactgttggagggtagtggtggtagtgaagatgcataggagtttctgagcttgttttggaggtagaggaggcaagatttgttaaagaactggcttagcagggtgggcacaaaggaaatacagaattaaaggataattccaaaggttccaacctgagcaactaagtagaggctggcatttactaagatgggtgagattgagagaaggggagtatcaggaggcaagattacttgttattttttagccatgtttacatttttttgagatatcttctgagtatctgagaagaaatttcaagtgggcaatttgttggacaagtttttggttcatgggagaaattaggacatggatgcaattttgtgagcctgtaacacacagctagtatttagagctaagggtctatatgaaatcacctaaatagtacttatagatatgaaagagaaggacagagcccaggggtactcttacatttacaggtgagcataaaaaagaaatcaaaagaaactctaaaggatcaaaagcaaagtagaagaaaaccaaacagccatgcgggagtgattgttgagatgttttgaaaaagagaaggttgacagtcatttaggaaggtgaggaatcaaacacagtgcagatgagggtggtgtagggagatcattctctaggtgccctttgcatttttgctcatcttacgatcagagtcactaactctcttggttcaggagttggaagatacagtggcctgttccagagcaaaggcaggttcagttgctgttcaggataatgaagataatgcctcccactgaggcaaagatcaacagagcttactgcccattataaaatattcagattccttaagcgcatggttcctctcctataatacaaacctcttgcaggtactgttgtcacctggcccttttcatatcaccctgtgaggagtggggcccagagaacctacacaaatgcaaacacttcaaccactgctattgtcataaagtccgtggtctctgacccaaagtctcatgtcccctgctagcatccatgaaacagtggcaggtgaactttgaaaacaggataggctaaaatctcagatccttcactactcttcacagatagtaggccattgtgatggtctacttgagctctgttgttgtggtggcatatctttctgtaccgatattcagttggtttgatgcaagcatggtacaggtagatgggtttatgccttagatatttaataagaatgccttaacacatgatcatatgtcttctttcttcactgacaatggcaccccactaatggagtgtgcaaatccaggaagaccagtgtttgaacgttgtggggtaaagtgccgataggtaagcccgcatatttagatatttctaagaggttctaaaatgatgaatactttcctcaatcatttgtcacaaccaaagtctatattcttatgcttagatgtcataattcatattaaagaattgggccttatataacaccttaatattaatagtacttggctaagcacagacgatcaacaacacttaattaatgaaactagttctgaatacattatatactttcagggtatataaggaggtaattacattttacagaggcatatactctatatctggtttattcgattgtgaatcaataaacatgggggttttttttaaaacatgatttctatgatgaatttttaatttaattgtaggaagctcctttaccgctgagtcaccagtgtcttcttgtataatataaagacattatggcctggcatggtggctcatgcctgtagtcccagcactttgggaggccgaggcgggtggatcatttgaggtcacgagttcaagaccagcctggccaacatggcgaaaccctgtctctactaaaaatacaaaaattaggcctggtggtgcatgcctgtagtcctagctacttgggaggttgaggcaggagaattgcttgaacccgagaggccaaggttgcaatgagccgagattgcaccactgtactctagcctgggagacagagtgagaccccatctcaaaagaaaaaaaataaaataaaagacattagccatctggagcagttaagtatatatttttctataaagcaatttaatgtagatgatattttctctctgtgtgtgcacaattgcatgcatatgtcaagtgtcgtgagattccaagtatttgacgatctgcttcttctatagacagttgggtacataaaaggagagccatgtgcaaatccagtctctggttctaggtttatacctcctcttctccacctccgctttccttgataacccctgatgcacacagccagccatcctcatccctcgagatgtggttgatttctctctatttgggtttcaggaaattgtttttcctcccttctgagagtctatgcgctgctgcaggccagtcagtattgattcaattctgggtgaatcctctctcactctttcctaagtgtatattgtatatgtagttcttctgccaaaagcagctttgtattaagattgtattaagatttaagttttcttaaatttgcaagtcacctaaaatatatcctgtgtctgctgggatccttttgatgttgaagcgtcttggagtagacaatagaggattttcatatggtggaagaatgttaggtgtccttgttggagaagagaggaagagtagagaacccctttaaagccctcttactgcctgttccttgcatctcatctctacatatttagcaatcacatctgctgatttggcaaacactaacagcagctacacagcgtcagtgaggacaatagtgagtggatttaaacatcaggggcgatgtaccagtgcaataaatagaatatatcattgtttcactgcggacagaatgtctgtgctctctatgaggatctgcatttaagcccaacacccaaggaaggcaaacatctaaagctcagcatggggtccttcaagcaggggaatacaaacaaagcatttttctcccaaaacacaagttttaggatttcatgtcaaagacatgctgccaatcagaagacagcattcccccttcttagagctggaaatggtaaccaggacacattggtatgcacaattctgctggctcagagcacacgcaagctcctaggctgtgactggcaggaggctcacagcgatttctttttttttgagacagggtctcactctgtcgcccagactggagtgcgcagtggtgcagtcttggctcactgcaacctcagcttcccaggttcaagcaattattctgcctcagcctcccaagtagctgagtttataggcgcccaccaccaagcgcagctaactttcttgtattttttttagtagaaacagggtttcaccatattggccaggctgttttcaatgtttttgaactcctgacctcaagtgatccacccacctcggcctccctaggattataggcatgagccaccatgcccagcaagctcacagcaatttttaatgcaatatgatcagacctaattttggctttttgatttcctcccttaaacctcaggcaggcactttttcaaaagagaaatcaatcagtcaatcaatcagtcaatcaacagtgagtgaatgaatgactaaattgtttgtttttagcatggcataaaataatccttaatattttgacctcaagcaaccattctgaccatatcttcttccatgcgcctttgactgagtacccagatacatgcagagtcaagttttctagatcacagccttgtcctctaattcagtgccttggtatgaaatctttcttcttctatgtcctttttttgccagatgaaatttcagtctttattcaagatcaagtgcaactgtctctttgaggaaagtcctttgaccgccatttctccccttcagaaggcaaacacctgggggagaagatctgcttaaggacctggtaactgacaaagaatggaatgggagcgagaaccgcctagccatcccttctccttgcacagtcatgaaacaaaagttgaaaaggagcctggttttacttgaccagtcataaattaccataaaataaaatgagatattaggaacctttgatctctgaaaaagtaatatgtgttgaaaagaaatatcactgttacatatagacaaataatagaaatatttgaggcatgcatttaaaatgtagaggccacttatagcaggcatattaacatgtgcatttgctttttaagaagtatacacacgtgtacctttagctttgaaagggtaagattcaatgcttgggtgatggatgcactaaagtctcagaagccaccactaaaggacttacccacgtaaccgaaaacaacctgtactccaaaatcaatgaaataaaataaaaaggtaagattcataaatagcaagttgagaatgcatgtttataccatgtagacaatgcatgataaattgttggcaataagacccatgtagctgactttggggatacaaagtagcttctgaaagaggttcctaattagccctgcctgaggtgactgcttaaggtatttatctgtagctggaatgcattgcctcagagacttgaggattcaggagctatgagtttcaaggccacagatgcagtggaatagtaaggcttcttcccctgcctggcacattgacctaactgatgagaggtgccttagggacccagcagctatggccatttatgtctagtccctcactctagaaaggaattgcttgaataccacggtgctggagtttgtagccacaatgctgaaggtcagggcagtccttcatgatgatgcatttctgtcagccatacttgcacatctctttaatgtctgcaatgtcattaagcagtggtgtatcatttttttttaatgcagaaactaaactgatactcaaaacctatgacaatttgaatccttcctgcctatccaaccttagtttttctgctcgataatataaattctccctttcagtcaggtagatagtcttcctgtcttcctgtcattcttggtttctctttgttgctcttgtcttccccacctgctgaaatgcttttcttctttctttcttttttttttttctgagaaaagacctcactctgttgcccatcctggagtgcagtggcataatgacaactcaatgcagtctcaagctcctgggtcaagtgatcatccttcctcagcctactgagtagctgggactacaggcatgtgccaccacatctggctaatttcttcatttttttgtagagactgggtcttgctatgctgcccaagctggtcttgaactcctgggctcaagtgatcttcccacttcagcctccaaaagtgcagggattacagacatgagccacccatgtacctggtttctctcttcttttctaactaatcaagtactttaagtcacaactcagggtgacaacctccacctccattgacttctccagagcatttcatttcctcttatcctttctctgcactttgttagaacttacattctgatttgtactgttgacctttgagcccttaagtttatgcaccttctctctctctctctctcgctcactctctctctctctgtctctgtgtctctctctgtttctgtctctctctttttctctgtcaattattttattctggtatttggtacttatgagaaatcttattagtatcctaaactctctcaaaacaggaaatgtgtattttccttctcatctaattcttaggaaacttcatataggaataaaaaatatgtagtagtggattgtctggtaaatgaataaaagagggatttgaggtcagtgggctgtttcaggacatgaccaaggaatgtggtaccagggcagcaacaagcttgctaaggggcgataaagtagtcattgtatataacagaggaatttgggctcaatgcagatttgccactaactctttggcagtatagaattcactagagaaatattagtaggttagttagtattcctaataaagaactgctaataccttatagagacataagccatgtttctcgtctttcgtttctgaaatgaaattttggccagggaaacattttgcatccctttttgatgtctacaaatgtggcatttgtcagatgtgagatagttaagtgtgtgtgtgtgtgtgtgtgtgtatatatatactttatatatgtatatatacatatcctatgtgtgtgggtatatatatatatatatatatatatatatatatatatgaatgatgcatggagagatatctctccatgcatccaaaatattcacaacttttcactaatatctgaataacatttgaaaaattgacaactcttctggctaaagatcagcatacacattcgttccacagagacttgtgccaaaatcttgctcagctcaaggggtactgcacaataaacaataagaaacttttataactccgactaatagaactcattgcttttccagtttgaagataaaggatgtctgcttgctttccatgcctaattttcctgatgctgtaaagctgttcaggaaagttcccactgcaggagttttgctagtaatcttcagctccgtgggaagcctttggactctgttgctatccctgaaagtggctgttcttctccatcagtttcctgggcaagggctcgaaccagctattagtgtctatttgcactgcatgaaaacaaaatttaatgtaaagacgcttatagcttgcctaccctaaaaccccaggagtctcattctgcctgaccctggacattttttgaactgatagagggatgggtatctggtgggtctcttcagtcagctcatctcagcatgttgaaagtccaaatgacccttgcctgaggatggtgaaagtaatttgtatgtgtgtatacataatcctgctttttcactatttccagtcacagattgcagagatagttgactgtgcttgttagtgtgagtgttaataactttgctatgctgatttttagacttcctatgctatatgatctccctgaagagcatgacagagcattgctttggaaaatcaatattcggcgtgattattccttctttcatgtgtaatcaaactttgaagaccaccaataggccaaatctacaagcattaggtttctaaacatattgtttagtcaggagaaattgtgttttctagctgaggtatgccagctactggtatggagaaaatctgcctagcaaattggaaggggccagaagctcaaatgctattgagaaccactcaacaattcttttttcttatacacaggattgaagcacagagcaaaaggaaaatccagctttgggatttgttcccttgaacttacaaatgattcattagaccaatgacattgtgagaatttggtctctgacaaagaaataaatgttttaaaaatagtgctaatacataggtacaaatacagaattatgtcaggcatgtatttttttaaagatagagtccagtgaaaagaatacgtgttagaatatggattaggtttctaaaggtatacttatgtctgccttcgtcttcagaaaacaaagttgtatgtacactttaagaaaggtcttagtgtggtaaacgtgaggcaaaccaaagtcctgttacttcttttgtcatatcattaaagcctccagacggaggtttcttcccattatgtgatgtgcagaatttcagatgtcagtcagcagctgaagtcaactgttggtccaccaggcctctaagctgcagcctctgtcagcttggggacagtgggatccatgtgacttgcctgctactgcccttgattgggcagatcacagagcagatggcctgtgtctagagtacaaggtgttaaggctttttttttggggggggaagaaataattcacatgtgctaatattcctggatgtttcactgataatataatatagaatgtatgaaaaaatcaaagtcaattagaaccagaaatctcctgatactggatgattctatacataaatatcttgcactaacagcaagaataataaaagttgtacaaaaaatgtctgttcttccccagaccatgagctccatggaggcagagaccttatttggttggtttactgcccttccccaatgtttctaccaagctgaacatgtatccagctctcagtgccccattgagttgaaataaattacagtgacataaactatgttcttcatcaaatgctggacaagcacgtttctcaggcaacttctctgggatcaacataagaacagggtgatgaaatgtgagaagcagtgagggcaaggacttgagcctggtgcctacctaaagtttacactccacaagtattccacccaacacttcagataccttctcttctttcaaagtcaacagtttatgcccattgaaaataaatacacacacccactcatgcccataggcatgtgtgtgctaccagaaaatatgtacatgttaggctctttggaagcagtggtagtttggtgagaattgctgcattggctcatcaacacagacctgatcgcactttgatttcatatcttgctatgcagggctcccattatctgcctgccatttgtgtgcatttatgtttagcgtcaatttctcctcccatgaggctataatctgccttgtaaggagctaaaatgggaaaagcagttagaatgatgagtccagttggagcctgctggggaacaagacagtcatcacaggccaatcggcagtggagacagggtggcccttatcacacagaggcatctggagactgagagagacaaagcaacacagctgcaagccgaccatgatctgctggaagcttcttcagtcataaagcaaaggacagtaattctgaatgacaatgtaggaaaacaaaaaagaagaagaaagaaagaaaatggttgagcccagacgatcatttttagttacggatgtcacaaatggtgattgctggtagtgaagtatctgaatctgaagaccagctgtatatagtatgtgtgtttatggaggtgtgtgtgtgtgtgtgtatgtgttggagaagacctgcatgcctagttgtagcactagccagaaattcttgtttcatcgtctagaatgtggccagaggtttgcctaaattctcataagtccattactgttcttctataaatcaggctgcctgttttgcataattcaccaggtaattcacctatcactaggcaaggcagctgccatggagtgcatgcaggaattcccttcattgactcaggctggtaccattctcagcatttttgctgtttatatatttttattttggtctcggttttcctttatctaaaaacgtcaagctgggatggatccttggagatgctcgcttaaacaagttcattacacttaaaatagttttacaagcacaagtgaaaataatgtaataattgcagcagattcttagacctccactggatcctgggttgcctgtttcctttactcagttctagtttctaagtttattgctgggttttgatgtatgtatgtgtgtgttaattttttaatatagaatatgaagtttgagggaaaactattgcccttattcttgtcgatttgttattcgatcttttcttttcctctttgttggtatgtgaggagttgcagagcaaagctgctgagatcttatatttgactgaggtttcacaagctctgcgagatatcctaatcttcagagtgacacctggtttagccaaccacgtggaaaaaactaagggtttagatataaccacattcaaccacagcctttaccttctcccctgtgctttgctgtatctaatgacggcccagaaaggtgcaaagagagacttttcagaaaaagcataaaaacaatcaagaaggaaaaaattgcttggttgttttctgagatacctgaaccagaagcaattgagtatttaggtgtaactttctatgacctattagaatgaatgccattcttatggcttaaatttttttcaagatgaagagggcacttatatagacaaagaatatatttcccataaagatatattagcacaattctaattaatcttaaatctaagtttttgttccccaagtccaatactcagtctagaacatatgcccttttctgtgatgcctgctggccaccatgtatgatcatggtatattgtgcattgtacaaagtgcccagccaagggctgaaatcaactagtgctctacttatgaggaattaatccaggcatggcgctgtgtctaccccagaggatgtgccttttctaattttcgtaaagttactgcaatgggccagccctgaagatatacagataacagaatcctatgacttttagatgacattagccatcatgagagcctgcctctctgtaaatggtgttagggtgtttattatcagcagcattgggaatacagttgttttgatgtgttttctgatgccctgttctaaaattcactacttctctgcaggctttggaaagtgggagtgtaaccactggtcctttgggttctttgtgaagttgtgctaaccataagatgccgcatactctcctagtgaccacagtttttatgggaggtgatgtacagcagcaaaagtctaatgtaaatctcatgttggttcttccagagcaggggcagctagagtctaataatttcttgggaagagtttctgtacctggaaattttagatgtatatcaaggacatgtgagcaaatgggaaatctaattgcccagtgcctctggagcaaagtgtagagacagaaccagaatgttttttaccggcacatttctgtattaaactaagggagggaagctctttaactatatgggaactttttctcattggttcctttaagtgtcttaaaaaaactgatgtcttcctaagagaacttgtgaaaggtggtaaaatgtttaattggaacttaagaataacttcctactgaatagctttgttgatttcactttcctgtggggaaaagatagacattgacaaaactgtttcgatgagaattaatcatagctgtagatttcaaggtatgttatgatactaggtttcatctcctggatcttcctcctctacattaaaatgattagaatgataaactcaaggcatattaatgatccctaatcaatgtaaaaaaattatcatttctcttctttatgctgtatttactgtcagaaatacagacatacatattaggaagatttttcttgaagggaattggcacaaaagggttgagacctttaattaatcaaaaaattgaccattccttgaaccttgattgtttggtatcattaacaaaggacatgagacaacatgttcaagctttataatttgctggaaataatattttctttttttttaaaaaaagcaattttttgttgtaattgttaatcttactatatatttgtctcctgaaaatggtgttatttgccactccttctacgtattaattggtgtaagctcttaagttatataggatagttttaatttctccaaaaagctgcctaaggaaagtaaaacaccataaagaaaagggtatgtacccaagaagtagcaagaaactaaagagaagagattgagatattatcatgagaatttaataagagaattaaatatctagaaaaatgtgtacatacttagaagtagtaaacattaatttcctttcttccatctatagttcacctctagatcactcttttctttctttagatcatcagtatccaagattggaaagagtaaatgagtgttgataaatgggcactctcttgttctgttgatataagcttaagttggggtagcttttctggaggactgcttgacaatatacgtcaaatttatattgtgatgtcctttggccatgcaatttacccttcctggaatgtacgctaagtagataattgaataagtgaaaaaccaaatgtcttcataaggatattcaccatagttttgttgaaaattatttacaaattggaaacaatctaaataaatgtcaatacaggaatagtttaattgcatatagaactgtacatacaatgtaatcctatgcagtcactaaaaatgaaaatgtataggtgtattgattgccctgggcaattaccataacgtataaatgaatgagtaaaagtatcacagaataatactcttccctcctaagtaaatcctcaccaataaatcctattatacaaggcaaaacctgtatattatccctatcccctaattttcatcatctctcatatctaatccaccatgatgtctttttcattcctaagtgtgtttcagatcatccacttccctctaactctatcactgtcttctggtccaagcttggtattcaattaatacttgttaaatggattctgaatatgattccattcataacagcacacctatccacgtacgtatgtgaagacacaggtgcctagagaggtgttcactgaactactaatggtggtttcctcttctgtggtagaattcagcattatctttatttttttatttgaatttctcttgttgtttgaaatatttttaaataataatgtgtaatttacccctctccaaaaataaaacttataaaatggggatgataactattattctacctttctcactggataaacatagtggtcaaataaacaaatactcgtgaaagtcttttataatgtgaaaacaaaggtttttttgttattatgtgcaataataataataataactatagatactaaaatttgttgaatatatttcctcagtattttgagtgtcttaactcatttaaatctcacaataagcctatgatactataaatatacccatttcaaatatgaggaaactgaagcagagacagacgaaataatttatccaggtagacacagccagtagagctgaggcaggatttgaccccacacaatcaggccctaggacccaagccctaaccactgtgccaaaatcataatacctgcaggaagtggcaaatgttgaacttagctccatatatcagactcttgccactgtgaagcccttacagataatttcttttcttttttgagacggagtctagctctgttgctcaggctggagtgcagtggcgcgatctcggctcactgcaagctctgcctcccagtttcacaccatactcctgcctcagcctccctagtagctgggactacagccgcccaccaccacgcccggctaattttttatactacctcagttaatttagaaagattttcaggcactgatgaatgattttgggagtaatcccaagccaaatgacctctgttggaagtaatttaatagatgtgtttaaatattagaggtgggtgagatggtgaagaattaacatttgaggaacatttggtatcctctgggcaatatgtagacaccctttcaataaatcctcacaacaccccagtaagttatgtgttatttgtttctattgtaagttgcagtcatagataaggaaactcagatatgtattaagtcatttgctcaggtctttacagctattaagttgcagagttgggagcccatctaaactcctaagatcagggtctggatcacctctattattttacattgggcatctatcatccaggacctatgtgctgcaggaacgtaattaagaatgactttgacaagataaatatttggggacatgaagcctgatcacagagtctaccagttatgtggacttgggcaagcaacaccatgaacctcacttttttcattctcaaagtgggactaatgaaatttttcctgcttctccaaaagataattttagtcactctgttggtgagttttgcaaaaacattgtagtataagccttcacaaggaattacagagaagaagataagtcttagcattcaagaagcctggactgtacctgtctcaaaattattttatgctaaatgcagacaattttctctatttggagtttctttcccatcttagttggcctcttctcagttttctgaatgaagcgtgcaccctcggatgtctggcctttactcctgcatgtcttccggtctggaataccttcccctccctcaggaacttaaccagcttcaacatgcagccttcctgaacactccaacatgaagggatgcccttctgttctaaatgtccactgcactgaacaaatcatttaatacaaatttctctgtagtttatacagaggatttgtgtttatgggcttatatgttttctttaaaaataagttataaagtttttgatgctagagcattcttttgtatccccaggagacactcagaatatatttgttgattgttttgattttaaagaaaaaggcggaagaatgaggtaaaatggccactatctgtcaggaacttcatataattatctctgcccagaaataaattaaaatagttttcttcagccagttgcaatagcttatagaaaaaaattaccttccctagatgtcagtgtcccaatttggaaaacagagtttggtcatatattttgtccgctgttgtacaacctttagaaacataaaattcaagaggaatactaaataaaaggatcaatcaatactgagttcagctttaaaattatttcatctaataatgctggttttcttggcagcactagcaagggctagaattttttaaaaatcatccttatatatgtattgattgaatttattaaaatgctttattaccatatccatttgcttataagaaggcaccctgatgtgtcctatatgagtttcaaaacacaattaaataaaaccatgcagagcaacaaacactacgtagcatttacaaactgcatttgtattcatttttatgtacatgaagggaaaaaaaacccaaaaggttgaaagccttctggagtgataaatgccacaatttagtggaaaatacacattgtaatttgagaacatctcccactaagagtcagtgtagctacagggacaagaagcctggtgctaaattgtctgaacattgatgtcccttcaaaattcatatgttggatcctagtacccagtgtgatataatcaagagataaggtctttggggaactgattaagtcatgaggggttctccatatgcatgaatgggttcatgctcttataaaagaggttgaagagagcaccctagggcctcttgcccttctgcttctgccatgtgagggcgtagcaagaggcactctttatgaagcagagtgagcccttgccagacactgaatgtgctggcgccttaatcttggacgttccagcctccagactgtgataattaaatttattttatttctaaatgactcagtctaagaagttttgttatagcagcccaaacagactaagacccctggcccacaggctcctgagcatctcagtgcctttgaggctataaaggacctcgaccttcactttcagcacatgttcaagtaaaagagaaaaatgtgtgtaaagaagtgcccatacccaataaacatacccatatttattgcaaattatcctctaaactgtttcattgtggtcaaaacccaagttataaatttttagtgtccttttaagagttcagtatttgtcaacctacggtcaacatttgcatcaacaaagaaggtaagatatgttgtgttatctttgtcatttttcagctgtcaactaggataggggccagaaatagcaaaactgtaaacttgaaattgtttcaggaagaagtgtaatagctaaggggtgtctatgaaatggaatgtatatcaatatgaggtaagacagctggtaaaaaataaaaaattagcaggaggggcaccggattcatgtaccagggaaaataatgtcatgttcattgcccagagagattcccaggaattagagattgagaaatattatttcttgacatgtctagaggctacgtggatagaagttctggaaaatgtttgagataaaggccaataaaaagcaaaaggacctgaggattctgtttattcactgaacagagaagctaaaaattgggctctcattttggacaaaaataaaagccatagtaataagtaaaataaaataacctaccaggtagcagagctcttagcaaaggattctgcaagcaaaaggcaggtgtgaattgggaaagtgagtctgggattgaggtgaggtggggttaggtgtagaacagggctatgaaggtcagggcagtggaaggtttgattctggaaagcatggcttcaagggaaaacttgagtggtgaacgggaaaatctgtgaggatcggaaatgtaagtctctatacttgctggggaaatgagcaagaaatgaaagggagagagccagatgacgcagctggaagcagaaatctgagcagggggaacctggcaacagagaggaggagctggaagaacaggggcagatcagatctagagccaagctgtattctctggccccatactttaatattctacctatgaggcgcagtgcctttgggtgttgttcataaaattccagtgttgaaaagggtttcagacattgtccgtgaagctcctctatccatcaagccctttgcaatatttacagtaaggaaagtgggagcgcttcagaaagagagagagagaaaaatgaaaattcctagccccatctagacatgccttatcagtgagttaggcgaagtgcacaaaatttaaaagtaagattctagttgtttgtattttagctattcacgttgcatcacaagagctccacaactggatttaaataattgtttctgccttagcaatcttaagtgtgcatgtattgttcagctattcctttaggggaaagattgctagatgggaataaaatggaaatgctgttttctaaaagttgtggtcttcatagggagatagctcttcacttcgtgtgttagtgatgaacatttgcaagctgtagagctgtagagaacactttgtggttcttctatttgaagaaaccctgatggctttgtcacatattccaagtttaacttttatttttaaagagtttatacatcatatttgaaaaagactcaaacatgtctagagttatatgttagacactaaacatacttgaaaaagatttaaaaccttggttttagtcatctgtaagtactctattttaaggacaactaattaatacttataactcagataattcaggagacgatcaatgattatgaaataacttcctatgacatacttttaaatagtaaatgccttcactgcatgtaattcacacatcaatatatactaaactatttccattaatatagccagtctccaatttacaggaagacattatgtttcacaagttgattttaagtgaattttttgtaatatagaaagaattgtcccaaagagtgactgctgaactggttaaatccacaaaaaaaagcatcacatgaattcatctactaggcaaatttgctcatccactttcaagtcaaaaaaaagttttaaattagataaaaacctgtgtatcccctttcttagtaaatttgcctgctgtgataaatatacacgtgcacacaaaaataggcatgcatttttaagaggagtagaaacccatttgaacttgtccaggaactcaagtttagaggctcaaatgtagagaatactaataaccacctataataattcttttggagaaggcatactgtattatgcctagtgcttaataggacaggggatttttcatctctcatgtgcctgggaatgagagccaggggcttcccccaattctaaaaaaattagcaattcagcagaatctacagtggggccaaattgtggctgggatttgggggatttcatcaaagtgggtcagaggtagaggtggaagagaagcagaaggccggtgggagtaggatacagtacaggggcgagcttccagctggctccatcagttgaggaagaagaagcaatcccaggaggtccatactcttgatattttatccctcctctcactaaggacagctatgccctttgtgatctgccctagactgactttttaatacagagaatgaaggccagtacagaaagcaaggagagaaagaagagaaatagatgctaagttgtccccttgaggaagaatgagggaaaatggagttcctgccaccctagtctattagctgacattgttactcctaattcaaggtaattattggtatgcaaagaaagtatgtattaactatatgtcaaccagtaactccctgaaatccacttgatgatagaaaattagtctatggccatatcactgtgaatgcaccaaatctcatctgatagcaaaatattgcatacatttcttctagaaactaagaattccaatgaaaagctatgaaagaatcctacttaggtctgaatttccatacattcctggtatctcagagggtggcaaggttagaaaacttgagaatctgtgggcacactagggatgaagtgatagtattctttgttggatatcaaaagaaatctaagcaggagaaccaaaatccattggtggaaccaaaaaaccattggtggtctgaaaagttaggtgggagaattgaatagcttagttctagggatcaagtaaccaccctgactattgagcttcccgataagacaacatgatggaaactacatggtttcatccaggtgctgggaacaagtcctactgaacattggcttttggacaaataacaggcagattctttggtgaagctttgttcatctgaaactcttccctgtcctctcttctccacttcatttttctgatgaggagaatggaagtttgtataaactagagtgctcaagcagcaggcagtggaagaggcaagacctccaagtagatctgcaagctctgaaccaagtgacctatctctaggccatattgaggaaggccaatgcagttttgcgatctctctacctcttcatttttccttttcctcctccccttccccttttgctctccccctcttcctctcaagagagtaatgtgctagtagtacctgatggtaccccagtgcttcctgccttcctcccttccacttcctgccttcctttctcccacttcctgccttcctcccttccacttcctgccttccccagtcccacttcctctcttccttcctggcaccccccagcactcccttccctccttctgttctccagtaccttcctttcttttcctttgcccttctctcttcctccttctctctttattttccttccttccttcctctgcaaggccttcttactagtttccacccattttcctatgtaaagcgattttgaattctagccatctgttaatacaaggcagtgaaaaatgttgaagtcacatcaaattccacttgctctgccagttaaaaatacagatgcttcctgttttatgctttcctctcactttctctagagtttaaacatgaaaatatgttccatgataaaaaccagcacatattccctttcatcaggaaacatattccaaacaatgaaaggaaggggagggggattattttcacaagtccagcaaggatacttggatgttgggggaatcatttgtagaaccataatttcacagagcaagaacataattattcacaactatcacattttatagatgaagaaactgagatcgcagggaattgttataattgttctcatatgtgctgcatatcgacttgccaaaattcacatcagcttaaattttcacccaacatgcctggtcctcaattgttccacaatactttttgctatccgctgatttcagaaagggttcttttggctactgggagaggccaaatcactaagcaatggataattaacctgaaactcagtaaatgcactggagtgaaaaaaaaatgtgagactaagagtcaagacacctgggttctagtcacaaatctgttactaactacccatcccaactcatagcaaaaatttttattaatactcttgctccacaaagagactagatcaaatggtctctaaatttactttcaactctttgaatcttgagttttcttccttcaattttctgctgactcagagcgtatagccttggccaagttatttactgccataaatctcattttttttccaagatgaaagggagaataacacattcccctattttcccagcatatatatatatacactatataatcttgcattaaattgactatctttagaaatcacattaaatcctttctatctatagactttggattagtcactaaagctagaataagacatgggccatatcattaggcaatgtctctggctgtagttgtattatcaaacactgcattgacgcttgttcatccttgcttccatcatacctttttatgtaagctgttctaattcttacatgactataacatggagcactgtatgtcaccatatctcttcctctcattgaatctgatcgtattctaatatctcctatctcaatgcctagttcttcacccattttaccaatgcaatatagaaactttcttactgcctttttatttcttacttttcttttgaataattcaccaagttattattgattttgtctgcctgatgtctttcaaatttatccacttttctctcttccatgatatcctaatctaagctaccatcacccctcaactgaactacagcagtcaaaagggttatttccacacagcagtcaaaaggattgtttcaggtgctaaatttggcaatgtcaccccactgaatggctttcttctggtcttaaagacccgattccagaacaaaacttacatggtaggcagctcctggcccttgactgtgtttctagtgtcatagtacatgctcctgaccttttgccctctttgagttcctcctcctcactatcctttcctggagattcaggtttggcagttccccggggttagaatgctcctccatgatttacctagttgctgcttattcttctggttttgtactgatggtcatgttctcagagcagccttctcagcctccctgggtcagttccctccatcatgcaccatcattgtgccttgtatccttgctgttattatacttatcagagtcgtaattttacatttgctcatgtcatactttttagattatgctttgctttcttctccttcaccagagtgtaaactctatgatactatgtctatttttatgtcaccattgtaattccagtgcctggcataatatctaatgcatagaaggtgcaggctaaaattctattgaataaataatgaatgaaaagaaagaatagaagtgcctgagttcaggccctgtatccccattccctcatatatgtggttggaaccatagaaggcaaaatttggtgttaaaagaataaagctggcaagcactgatgtgcctaacaggataggaagttcagaattcttttttaaaagtgttcaagggcccaggagtgcctggctaacataatgagacccagtctctacaaacatttaaaaattacacaggcatggtggcatgggcctgtattctccgctactctggaggctgaggtgagaggactgcatgagcctaggaggctgaaggcttcagtgagctgtgatcacaccactgtagtccagcctggtcaacagagtgagaccctatctcttaaaaaaagttctaggatattggagttgataatgtttgtaaagatcaacgctaacattgcctccaaccaagtctcaatatgctccaaaaagaaatacttcaaattaaaactcgtgtgtgtgtgtgtgtgtgtgtgtgtgtgtgtgtgtgtgtgtaaggagaggtggctcatacctgtaatcccagcactttgggaagccaaggcgggcggatcacttgaagtcaggagttcaagaccagctggccaacatggtgaagctccgtctctactaaaaatacaaaaattagcgtgctggcatgcacctgtagtcccagctactcgggaggctgaggcatgagaatcacttgaacctgggaggcagaggttgcagtgagctgagatggtgccaccgcacttcagaaacagagtgagactctgtctcaaaaaaaaaaaaaaaaaaaaaggccgggcatggcggctcacgcctgtaatcgcagtattttgggaggccgaggcgggcggatcacaatgtcaggagtcccagaccagcctggccaacatggtgaaaccctgtctctactaaaaatacaaaattagccgggcgtggtggtacatgcctgtaatcgcagctactcggtaggctgaggcaggagaatcgcttgaacctggaaggtggaggttgcagtaagcagagattgtgccattgcataatggagtgaaactccatctcaaaatatatatatttttatatatttttaaatatatgtttataaatatataaatatttttatatacatatctatatatagagagaataaatatgtatccacagagagagggagagagataccaagacaaacttataattgctataaattcaaataagagagaagtcagtaaaacctagagtaactaggaaatactccctagaggccaaatttgacctgtgctttgaaaggtaattacaattgggacaggaaacggcacggcttctttctcaaagattgattattctgactattctccattagctcttccttatacactttccactttcccaaactctgtcccgggatgctgacatgaaccacgtcaacaggactccctcacatcctgtcttcaagtagcatttgcccagagagaggcctcaggcaggaggttgtaggatggaaggagagatttgcaggcattcatttccctgctccctccctgcctggctgcagtgggtagtagctaattcctcttctgaaggccacagctcctggtggatgcccccttctcacttacaactgagcttctcagtgggttaccccttcacaactagggttggtcatggctttctgatgctgtgatcacccagggtacttttaaactctctacttatccgtctggggtgccatgtgttatttgctaagaatgaggtaataggaattttttaaaaaaagattaaaataatactatcagcctgtcaatggggattcctcccacccccaaaaatagagttgttcgtttctctttgtttggtttacatgatatatatatatatatatatatatcatgtatatgtatatgatttacctcaaaacagatcacaaagctgaggtcacttgaaactgactattacaagctagctggtagaattaaacttgtttccctaagtaaaatagaaaaatttggccaagagataagaaaatagctgcccctcaccaccacaaacacatacatacacactatactgaatggatcttcatagagagtaagttaataagaggccagcccctacctctgcttccctccccagggacatacatataaatagttcagttatgtctgacttaatagatttgggaaggaggaaacgtgagaggctagtccttctgaagggttgggaggtaagggtgagggaagggaggggagcaaaattacggtactgggatttggacccagataaaagctgctttgtcacatcatcccgatgtaaaatccgtgcatctgagagatagcccctgagccaccacacaggctcctcccaccagagtctgtctggcaggggtcagtgctgcctcgctgtggattagagggagtcatcgacatgtcatctgccatcaaccacacttattgtgaggaaaagaatgccccatacacatagaggccacccttgggatggacttttgagttgactaaagagtaaaaatcacaatggatcatccactagtcagcattattacctttactaacaaaaccagtagcttagccacgatcgtataaaacaataaatgttggttaatttctaaagtacattgattgttttagtttttgttttaagaaaaaggcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactctggaggctgaggcaggagaatggcgtgaacccaggaagcggtgcttgcagtgagccgagattgcgccactgcagtccgcagtccggcctgggcgacagagcgagactccgtctcaaaaaaaaaaaaaaaaaagaaaaaggctttatgtggctgttgggaataggattatttcctctaacatttatcccagtatttttaaaataaagaaacatttggtcgatgaaaagtatagaatatttgtggtaattataataagtgaatacattacataatgtcctttgtgaaaaaggcttacattattataatgggaaggaggtaaattaatctgagtagtattagtataatagtcttagtaattataatggaatgaatcaccctatattataattatgattcaaataatatatatttttagagatcaaccgtttcatgatgtgctggaatgggatgtggtaataggagagcagtgattttggctaacacattaggtattctgagtcaatttggcacaacagcagaaattattttctctattgtcttattgagaagaaacgtcctaagaaggatcttggggaaaataaataagtatgtgagtctgacataggaagagagggtttcttcccctgcaaggcaccttgtgaaagcctagtggggagaaatagtgggatgatgaaggatggggcaggttacttctggaagcaaaattcagatcccgagtgcaggtgttgttcaggcctctgtgccccactgtaagtgtgctggcttcattgaaagggatgagaataaggcagacacgttcaaatatgcagagtgagggaaaatacaaagagcatatttgatattggttgaatgattgagaatatttgatatttgatattgattgataattgatgagcacttactgtgtgactaggaactgaactaaatgctgccccagagatcattcttatttatgctcacaccactcatgaagcaaaccattgttgttattttcattcttcagatgaggaaactgacagtcagtgatgctaagaaacttgctcaaggtcactacagtagttattgtgggcctggggtttgaattcagcctaactccagagtctatgaccttaaccattaagtgaaataagtgaacatcttcatgttcaggacatgtgatgtgtgtgcacacgcatgtgtgtgtgtacaaaataaaatatttgaagccaacaggatcctaagtctgggtgggtcctaatgccagagtgcttagggacacttcctttttaagcaagatagtttgacattgtcagcttttaattgtaatttaatttcttgtgtgaacattattaaaatgtattaaaaccagatcaaaacatccaagacttttatccccctgatttttatagaagccctctgcttacaagcacttaaagagagatgaatccttatttttcctctggtaagtgatttctaaattcccgtagaaaagcctttaaaaagaaaactcaactagctgcatttatggacttgaatacctacactctactaaaattattgccttttcttaatgatgttcctgactcatcctgaaaattgatcatatatgtataaggtgatgctcactttacaggtggagaatgttgtagccacaagtaatgaagactaatatatagatatttaaatccacattttgtccagaattctcaagcagggagttctaacctagccccacccctcattccctcattaagcattgttttcttagaaaggattaaaactggtaatatatctgtaatcaattagctgacatgacttaaaattgataagtcatttgatgaattctcatctcaaattccgaatgaataaacaatgagaaatgggaaagcctttggcagagagagactcattgaatcagttaattaaggaaagagaaagagccagagtacaagctatcaatatcacctacatgggtcaagaactcatccttatgtgtgtaataatagagctactcataaacctgaaatgatacaattaattacggaagttatagaatattggagcatcctcgggtgaaaaataattgtgtctatattataaaagtatgcaacataacacattttatctgcatttaacattttgttggtgtttcatgcaaatgaaaaaaaaaaaacactgtttttatgatttagccaaaccatgctaactctagtaacaaccctcccaatctcagtgttttaatgcaacaaacagttgtatcttgttggtataaattccactgcattgttcttggttgggttgttccttaaagaggatactcaggaatccattctcttcctatactgttccagaggaagatggctcctccattttcaatacgtggcttcaaggtcacgctgacgttgttcagacagtgttctgttggaagagtgagagaaaaaagcatgtacatacaattccttccaacacacatacacttaactgctttggtttgaaagtgacataaaccttctgctcacattccattggccagaattcctcacacagtccccacctggcttagtgctcaggaagaggaaatagatttgatgatcatctaggcaatgtctgtgatgagattggttcaaaaaatgtaccagtaaaaataaaaataatcctgttcattacattccagaaaatgaactgattaaagacaaatatgtatgcatcacttttctctttacgtagtgaagcaatgtgaaaaacatattaattgagctattcatggcaagacttctctttataaacttcatacatctgtcactaaattgatatgaaagaaatatttgatctcagaaagaattttatctatcatgatggaatgctggcagccaaatgtatacctaaaaattgctgaaatattggagtaaaaaggaatagttagatcgatcatcttaattttgtgaaagcatgcgtacatttttcaccttggattcagttgtgttggcattttataggcacagttataaatttgcctaaaatacagaatggcattacaacaaaactcagactcatggtgtaatcattgtttttttcaaactaaaaacaaagaatgaaaaataaaaacctctaagaacaaaattactccatttaattaaattaaacagacaaaacttggaggcatagtagagatggcaaggaaaggcctcagaccccttacccccatccaggggaaatatttgccagccactcctatcttcagcaaaacttgagttatgatgtaaactcaagactcttaaatttgtgattaatcctgggtgtcttgaaaattggagagtgggttagcaaattcatagttccccaaatttgtgctatctactgctgttttcttgtggattataagcttgaaggaaatgtgctgcctagagatatgagctgtgtgtaattactcccacctgctgggtaaaatctttattacatgggcattagacttcattcccatcgaggggtgaggaggggtgcaatatgaaccaaccacaccacaaggcttgtgaacatccttcctctatggtgtctcctgacacttctttccagcttccaaatgtgatacaactttgactggaaactgtgaaccaatgtgtatccaatgaaccaagggagatttagctccttaaaagaaaattaaatgtagaaagatgtggaaggatcaatgaatcatatttatccaataagtggttcaacaattacaagagcgagacaggaagggaacccttccaggcagagtggtcctcagctctggttttccagcctagagacccatgtggcaggaacttggccttcatcattgaataccctgcatacacccttcctcaagcctcctttgtatgtgtgagagcactgacttcagaaacagaaatgagtttccagccctcaagggaactgtttgctaaagattggcaggagcccacaagactacgacacagtctttgatgagctggctctccaagtgtgggcagacttttgtttctaagttattgggaggctttctgtgggtataaaacctgcaaaaaacacaagcatcaatgttgccatattaataactgctttcatccttggcaagaagaaaaagaacgtggggaaaagagtcaggcgcaaacatggtttgagttttattgtcttttacttgctcactgcctacacctcccaccagtagctttggaaagagagtttcagaaatgttatcttatgttttttatccctaagaatggggtcatagtcttcaatttatgcctaaagtgtttaactactccttcttaatttactcgctctgcccaggaagaaaacagacataacttgcaaaggtggaaacactggtacgttaggaatatcattcattttcggattcttggcccttgagtttcactgttacttaattgacaaagctgagctgtttcatttcacgctaggaagtctttggttaaattgcaggcttgggtttctgtcctttggcagtggaagtaaagagaaatcagaagcaatgtagcatttatgaaccactggctcctctaactgcctctgtggcttcaaatcctgatgatgtcaattgtggtttgtgtatatgtacgtgtgtgaatgtgtacacacatgtgagtgcgtgaacattcgattcatttctcatttttgttctctctcttttcccctcacctccggaccttttcatccttctttatgttctgttgccttcatctcttagtttttctattctatgccccttttgtttctactcttttcatctgacctattattatgtcatcagctataagcaccatggaaaacactagtttcatcatctccatctgaaagaaaaaaaaaaactcaacaagggagaagctgaatatatctgtcttcagtatctatctttgaatttggaatgcttcctgccaagaaaattatattctgaaactccttagatcttgcagtcttcatgaagcacaccagccaatagctgcctcctgacatcagctcagatatctggttgacttttgctgctagctcttccagccaatgaaagtagataccttaggccagtgttcccagacatttaggttttatgggataataaaatctccaggagcaaaatgaagaggctgatatattgccttctctttaaattttaacacttttgaaaaactgccatctacacactaccgctttttacattttaacacttttttaaaactaccatccattgtcatcattattccataaaaagaggtattttaggaaggatactcacaacataagttggataaatttagcaattaaaaaagcactgctttacttttatcttctcctttaatcaaagatgggatatgaatatcaaccagcattgatccaattttaggcccttagttccaataaaattgttccttttcccatataaatggttatgcctttgggccaattgctctgtctctcagaggttattatatcctgttgcctctatattgaggattgctgtttcatctttggagttacaatgtcccaaagggatcactgatacattcttagctccagtatataaatagaggcactaagaaataaaatgagagggttttgacacctctccctctcccccaccccccaacacacacaaacaagtaaatgggttagcttttatttctacaattgcacagcatatttagtgagagagggaagttggaggtgggtatcacacatgtaagatattgcccttattttttttttttttcagagacagtatctcattctgttgcacaggctgaagtgcagtgcctcgaacatagttcactgcagccttgaactcctgggctcaaacaatcttcctacctcagccttctgagtaactgggactacaggcatatggccaccatgcccagataactttttaaaaacatttttgtagagatagagtctcactatgtttaccaggctggtgtcaaactgctggcctttagtgatcctcccattttgccctcccaaagtgctgggattacaggtatgagccactgcacctgtcctggcccttattattgagtagattgtagtctaatgaaaacatatgagtataataaacaaaagaaaaaagaaaacatatttagccaattcatagcaaaaggcagacagaagtagatgctgaatagagaaacaagactgttagagggcagagaaaggagtaattcattttgctggaagaatcaaggaagcaatcacaaaggtttaatgtgtaattctgaatttatgtgattgctatataatcattctgtttcatggctgcagtgtaagctgtgtgagggcattgtttgtatcagatgtctgaacctctttatctcatcccttatcatagtgtctggtatctagtctataacccataatatctcctgaataactgaatgggtgcctacaatgataagtggtgtgaaagataccaagaaaatcaagtatcattcattgccccgaaagcacctgtgagcacataggtttgcaaacatgccacatgtgttcggtcagcccattgcttgtgtacatgatcatagatggtcatagggatttacttcattctgaaatggaataatttcatcctcaccctgctttaccttaggtaaagattttgatgccatttttattaagacatttacttggaagtaaatgtcatgctgtgaagagccattatagacaaatattgtagccacttgccaagtaatgacttatgctgggaagttgcttaaaaggctgattttattcattttatttgctatacccttgtgctacttagagaagggtagagaatgagagaggagcaatatgttttgttctcttttttttcataaatcagtaattatttgcagagtgttttgtgtaaagtgctcagctcacaactggaaatagaatcctgggttagacagtggccatagtgatatttacatatctccagcttgtagtttgccaattgaaatgcagacatatgcggaaattgcctcattgtcattccttgtttttgtaatattatccttggctctacggattcattttttttctccttctactgtcaacactgttttagcagtgagttatattatccggtgacatcagagaagcaaagctacatgtgtcagcttggcaggaattgtccacttacagcaaatttgtgacaagttgtatttttctaccattttcacctggagtgacgaagaatctacagttgagggagacaacatggacctcccctgatggtaacagtgctatgtccaattgagctgctgttgcttcagtaccaaagaggaaggagctggtgatctttgaataatccttcccctatgaaaagtaggaatgtatccccagagttcattgtctgtatctgtaggtaatggaggcttaactggcattaaaatcatagccagtttcagacccattaagtttaatggtttttgtaatgataggctgcaactgatggaataaccaaaagaacaattcatggactgtttatggaagaataccttcaccattcaaaatggacattaaactatggctggtttcattgcaaggcaaaagttccctctttatcttctagttaggtccatgtgcagcccaggaggtatgtaaaagctatactttaggagaaaagttgacttgaagcttttaagctaatgagtttgaacttggcatgttttctattatcattgtctttaatcagtggtgttatataataaggagctaataaattaatctaagtgtaagtcaaattaatataagttaaagtcaaaatccagctaggcaaagccagataggcatattaaaatggcagcccctaccccaattccttgataatccattaaaagtagaaagttttggttaggaagccacctcctgttacgtaaatcagaatgtaagagccatgagattagggattttcatttgttttatccacttttatatcctcagtgtctagaaaaatgcttagcatattgcaggcactctgcaaatattgaacatacggggttgatgaacatataacccattttggttgatgtagttttatttcttaagaggtaaaaattctttcagaaaaagaaaagtaatcatttctacaaaataaccctccactggttgatattcttcccagatctacctttcttcacacagatctttttttaagagaaaaccacagggatatgtggctggtgcaatcaatgataggtttgggatatgataaaatgtaggaaatggctaaatgggagagtacatgatttataaaatagaatttaaaataacagccctcaacagcagatctttgccagcagcacatgatgggaaaatataaaccccattctggggatggcatctggtacagattgagaaataaattgggcagcgaaacagaatgtgtcttcagtggtccttaagatcaaaccaccaatgataagcatggatcattggagcctccaccttgctctttttgaaacagctaaaatcagcaagggaatgaaaaggaaatggctttatcatctgtgagcagcttgcccctccctctggagatccaaatctccaaacatgcattttgatatactttgggagttctctttatctagtaatttcatttaggggaaaaaaatatagctctccctgcccacatcccacattgttacatcactgattcctcaccatgctaacacattcaataatctgacgtgcaactcaactagaagagcaatcacagccagtgatgggccggcatcatggagagtaaagacaaatggaaacaataataactgtggaagaagcagatctcaaatgggaaactcaatcccagtgatcagggaaaactccaaaggaaggatatgagttcaaaaaaatcaattcaacaaaaacttattgtctgtctaccatgtatcaggcatggggatatattactggtcaacacaatgtgctttgctgcctggtgcctgtgttctgatatctggtgtgcatgttctcaatggtattgcaagttgcattgggctagaatcatgaagtattatcaggggatttacttgaaattaaattagtcccattcttgtggaaatctggagctggcatatgcatggaagtgaaggtcttgttgctggttgaatttagtgccctctgcaatgaaagccaaatcccaactttagtctgtgactggggggccttctacaaagagaatgaattttaacaattaaccaacaatctaaattcttggaaagtgaaagtttctaaaacataaaatccatgaagacagaattagaaaatcaatgtgtcctttttggaggaagaggaaagccgctggctgaccacgtcactttcatgtttctactcaaatcttatcaacaaggcctttgttgaccattcatccccttcctaggcccccttatttctatgtctgtcttgtatcatctgacacattgtaaatgtccttatttatttgcttactgtctgtctcttcactctgaaatataaattccatcatgtcagggactttttcttcatcttccccaaatgatgtttgaagcctcccatctaatgctgagaggtatttccctagtagccctgtcatcactttcctaccactgtccctgttgccacataatttaagattccctgtggccaatgctgatgtcattatcatggacgtccttaggaaacgaaaataatttaagcttctaaaatgggcaaattcgatgtagagttgatgggtacatcacacacccatctagaaaagagcatctcaggttggtacctgaaacttggtagactccaccccaagtcacatggccaactgatgtgttacttcttagacatcctgctttctctgtccataggcctggttgggtggtctttttcagatactaaatcatggtacaattggttttcataaaactagtactctaattctacttttccagtagccttgagtaaaggaatgttgaaaacttgtagtgatgaaacgtgtaggatttgcgatttgtcggagtagggacaaaactatttgagaacatagtccagctgaccaaaagaaaataagttctcatattactaataacttttagggatccaataggctcaagaattctgaggttgggtttgacagtgattagtgtaaattaagtagaagtagttaagaaagtggctgaaattgaaggatcggttgtggttagtaaatatggaggattgaaacacaatgcaaacttgataattgataaccttcatttaattctaactaaaagcccactttctggtccaaagttggaactaagaatgaattctttttactctgagaggatatttacaaagaaaacacaaacacacaaactatgggtaacacaaaagcaaactagaatgatttatcttattattctgttatgggttgaattatttcctcaaaaaatatatgcttgtcttaaccccagtgctgctgaatgtgactttatttggaaatagagtctttggaggggaattagtaaagatgaggttatactcaagtaaagtaggtccttaatccaatacaactggtgttcttattgaaagagaaaagacaacgtaaagacatagacacacaggaagaacaccatgtgaagacaggcagtggtcagaattatgtatctacaagccaaggaatgcctgaggttaccagaagctggaagaggcaaggatcccctccagagcccttagaggaagcagggccctgacaacactgtgatttcagacttctctcctctagaaccattagacaataattttctgttgtttgaagccaccaaatctgtgatactctgttacacaaatcctaggaatttgatacaccttcctagacccaagtggggaagaaaagggagaaacaggtttagaggtggagtaaaagataacagcttctcacaacttgaggcaagatgcgtatgctgatggcagagaaaggagttggcattttctgaaagcctgtcagatcccctgctttgtctgggaaggggaggaatatccacagcgtcttagcaggtgaaatgcagcagcgaagaccaggtgcctgtattgttgcctctggttgtgcagatgaagagtcattaggctgacctcatctatggacccaactggaattagccctgactctagagccactggatgttcaggcaaaactgaccctaaaattctttttaaatgcattgcttaagccaagcattctcttattcaaaatcaagctgctgcattttcatgtagcatgaaatgcaattttctatttaaggtgttcaactaacttagggataggttgatggccaaacaaagaaggtttcattaagatggaaatgatttggagtatctagtctccaaagtgattgctctagagacatttatcaatccaccggtggcttctagtcgatatttggttttataggttggggcaaaagtaattgcagtttttgactttttaattgcaaaaccgcagctacttttacaccaacctgataatattccccagatccttccctgcttcctctcattagtaaccagagcaggctgagaatcacttacctgtctcttgtgttccacaatgcacactttgaccccatctagtctcttccaatatcatttactcttgtccattagcggattttctttacttcctgtgtgtctagcttgttggggggatagggaggagaggagaggctgaggatattttttctgtgtgtgtgtaaaggttattcaaattctttatcacttgcttttgctttttaggaagaaaaaaacatgaatatcttataacactattttttaaatgaaattgttcagcaaattatacttaattatatttttaattttaagttctgggatacatgtgcagaacatgcaggtttgttacattggtatatgtgtgccatggttgtttgctgcacctatcaacccgtcatctaggttttaagacctgcatgagagggtggagccaagatggccgaataggaagagctccagtctagagctcccagcatgagcgacgcagaagacaggtgatttctgcatttccaactgaggtactgggcttatctcactggggaatgttggaaagtgggtgcaggacagtgggtgcagcgcacccagcatgagccaaagcagggagaggcattgcctcacctgggaagtgcaaagcgtcagggaattcccttttctagtcaaagaaaggggtgacagacggcacctggaaaatcgggtcactcccaccctaatactgcacttttccaaaggtcttagcaaacggcacaccaggagattatatcccacgcatggcttggagggttgtatgcccacggagcctccctcattgctagcacagcagtttgagatcaaactgccaggcggcagtgaggctgggggagggacgcccgccattgccaaggcctgagtaggtaaacaaagcggccaggaagctcgaactgggtggagccaaccgcagctcaaggaggcctgtctgcctctgtagactccacctctgggggcagggaatagccaaacaaaaggcagcagaatcctctgcagacttaaatgtccctgtctgacagctttgaagagagtagtggttctcccagcatgcagctggagatctgagaacggacagactgcctcctcaagtgcgtccctgacccctgagtagcctaactgggaggcaccccccagtaggggcagactgacacctcccacagccaggtactcctctgagacaaaacttccagaggagcgatcaggcagtaacatttgctgctcaccagtatctgctgttctgcagcctccgctgctgatacccaggcaaacagggtctggagtgaacctccagcaaactccaacagacctgcagctgtgggtcctgactgttagaaggaaaactaacaaacagaaaggacatccacaccaaaaccccatttatacatcaccatcatcaaagaccaaaggtagataaaagcagaaagatgaggaaaaaacagagcagaaaaactggaaactctaaaaatcagaacgcctctcctcctccaaaggaatgcagctccttaccagcaatggaacaaagctggatggagtatgactttgatgagagaagaaggcttcagacaatcaaactactctgagctaaaggaggaagtttgaacccatggcaaagaagttaaaaaccttgaaaaaaattagatgaatggctaactagaataaccaatgcagagatgtccttaaaggacctgatggagctgaaaaccaaggcacgagaactacgtgatgaatgcacaagcctcagtagctgatttgatcaactggaagaaagggtatcagtgatggaagatgaaatgaatgaaatgaagcaagaagagaagtttagagaaaaaagaataaaaagaaatgaacaaagcctccaagaaatatgggactatgcgaaaagaccaaatctacatctgattggtgtaactgaaagtgatggggagaatggaaccaagttcgaaaacactctgcaggatattatccaggagaacttccacaatctagcaaggcagggaacattcaaattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatcctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcattaaacatggaaaggaacaaccagtaccagccactgcaaaaacatgccaaattgtaaagaccatcaaagctaggaagaaactgcatccactaacgagcaaaataaccagctaacatcataatgacaggatcaaattcacacataacaatattaaccttaaatgtaaatgggctaaatgctccaattaaaagacacagactggcagattggataaagagtcaagacccatcagtgtgctgtattcaggaaacccatctcacgtgcagagacacacataggctcaaaataaagggatggaggaagatctaccaaacaaatggaaaacaaaaaaaggcagggattacaattctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagaccaggaagagacttagactcccacacaataataatgggagactttaacactccactgtcaacattagactgatcaacgagacagaaagttaacaaggatatgcaggcattgaactcagctctgcaccaagcagacctaatagacatctacaggactctccaccccaaatcaacagaatatacattcttctcagcaccacaccacacctattccaaaattgaccacatagttggaagtaaagcactcctcagcaaatgtaaaagaacagaaattataacaaactgtctctcagaccacagtgcaatcaaactagtactcaggattaagaaactcactcaaaaccgctcaactacaaggaaactgaacaacctgctcctgaatgactactgggtacataacaaaatgaaattaagatgttctttgaaaccaacgagaacaaagacacaacataccagaatctctgggacacattcaaagcagtgtgtagagggaaatttatagcactaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggaaatagagacacaaaaaacccttcaaaaaatcaatgaatccaggagctggttttctgaaaatatcaacaaaattgatagaccactagcaagactaataaagaagaaaagagaagaatcaaatagatgcaataaaaaatgataaagggtatatcaccaccgatcccacagaaatacaaactaccatcagagaatactataaacatctctacacaaataaactagaaaatctagaagaaatggatacattcctcgacacatacaccctcccaagactaaaccaggaagaagttgaatctctgaatagaccaataagaggctctgaaattgaggcaataattaatagcttaccaaccaaaaaaagtccaggaccagatcgattcacagccaaattctaccgaggtacaaggaggagctggtaccattccttctgaaactattccaatcaatagaaaaagaggaaatcctccctaactcattttatgaggccagcaccatcctgataccaaagcctggcagagacataacaaataaagagaattttagaccaatatccctgatgaacatcgatgcaaaaatcctcagtaaaatactagcaaactgaatccagcagcacatcaaaaagctgatccaccatgatcaagtgggcttcatccctgggatgccaggctggttcaacatacgaaaatcaataaatgtaatccagcatataaacagaaccaatgacaaaaaccatattactatctcaatagatgcagaaaaggcctttgacaaaattcaacaactcttcatgctaaaaactatcaataaattaggtattgatgggacatatgtcaaaataataagaactatctatgacaaacccatagccaatatcatactgaatgggcaaaaactggaagcattccctttgaaaactggcacaagacagggatgccctctctcaccactcctattcaacatagtgttggaagttttggccagggctatcaggcagaagaaggaaataaagggtattcaggtagtcaaagatgaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatccacccataacagacaaacagagagccaaatcatgagtgaactcccattcacaattgcttcaaagagaataaaatacctaggaatccaacttacaagggatgtgaaggacctcttcaaggagaattacaaaccactgctcaatgaaataaaagacgatacaaacaaatggaagaacattccatgcttatgggtagaaagaatcaatattatgaaaatggccatactgccaaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactacaaggctacagtaaccaaaacagcatggtactgataccaaaacagagatatagaccaatggaacagaacagaggcctcagaaataatgctgcatatctacaaccatctgatctttgacaaacctgagaaaaacaagaaatggggaaaggattccctatttaataaatggtgctgggaaaactggctagccatatgtagaaagctgaaactggatcccttccttataccttatacaaaaattaattcaaggtgattaaagacttaaatgttagacctgaaaccataaaaaccctagaagaaaatctaggcaataccattcaggacataggcatggacaaggacttcatgtctaaaacaccaaaagcaatggcaacaaaagccaaaattgacaaatgcgatctaattaaactaaagagcttctgcacagcaaaagaaactaccatcagagtaaacaggcagcctacagaatgggagaaaatttttgcaatctattcatctgtcaaagggctaatatccagaatctacagtgaactcaaacaaatttacaagaaaaaaacaaacaaccccatcaaaaagtgggtgaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatattcccaaaggattataaatcatgctgctataaagacacatgcacacatatgtttattgtggcactattcacaatagcaaacacttgaaaacaagtgaaatgcccaacaatgatagactggattaagaaaatgtggcacatatacaccatggaatactatgcagccataaaaaatgatgagttcatgtcctttgtaaggacatggatgaagctggaaaccatcattctcagcaaactatcgcaaggacaaagaaccaaacaccacatgttctcactcataggtgggaattgaacaatgagaacacatggacacgggaaggggaacatcacacactggggcctgttgtggggtggtgggaggggggagggatagcattaggaggtatacctaatgttaaatgaggagttaatgggtgcagcacaccgacatggcacatgtatacatatgtaactaacctgcatgttgtgtacatgtaccctaaaacttaaattataataaaaaaattaaaatataaaagacctgcatgcattaggtgtttgtcctaatgctctgcctcccttttccccccatcccttgacaggccctgatgtgtaatgttcccctcgctgtgtccatgtgttctcattgttcaactcccacttatgagtgagaacatgcggtatttagttttctgttcctatgttagtttgctgcggatgattatacttaaatatttttaaacaaggctttagacctaaatccatcaaaataaaccactttgcatgaaaaaaaatcatgggaccatttcagcatgttctataggtgggctgatttaaatgatttccttatacatctctttctgcttgtgctattgaataattgagaagtttgcagggggtgtggtgccttgcacagaccgagaaggaagagaaaggaagcaacacttgcaaaaggactttgttgtgtacagtgatagaatgctctacctgtgttactcattgaatcaggaggattgttgaaggaggagggctctctggaattgtaatctgaagaatgagggttattcatcaggaaaagagggcaaggcaaggggagggggaagcataggagaagaaataaaaggcccagaattctgaaaaactccatgctaaaagacccagaattccgaaaaactccatgtcagcagggtcaaaataaattttgtggaatggttacttagattgagagaaggactaatgagaaatgaaactagaggtagagtcagagatcagttaatagtcttctattttaggttaaggaattcccatttcattctgaaggtcaaggacaacttaggtaaagggcagtgactaagaaagaccaccctggtcaggctcgatggctcacccctgtaatccaagcactttgggaggctgaggcaggcagatcacttgaggttagcagttagagaccagcctgaccaatatggtgaaaccctgtctctactaaaaatacaaaaattagctgggtgtggtggtgcaagcctgtaatcccagctgctctggaggctgaggcaggagaatcacttgaaccctggaggtggaggttgcagtgagccaagattgcatcattgcactgcagcctaggtgatagagtgagactctgtctcaaaaaaatagaaagatcattctggcttttgggtggagaatagactgtccatgggcaaagtcagagtccaggaggccatgccagaagctgctgctgtactttaggcaaattctatgtggtggtggcattggtagtaagagtggagaggaatatacaagttagcgatacatttaggaggtaggttcgataaaacttggtgatttattaagtttgaaagtgaagaagagggaggagtcaggattgacttacacatgaaacatataagacttctttctgtcctaaaaaaaaaaatcaccgttgtagaaaatgatagaaactgatggacataagaaagcaatcaggatctcgattctcaatgccatgtgaagaaccacatgctcttttgacattttaagtagagatgtacatttggtttctgcagatccatttcatagctcggctatgatttcagactcattactcaaaagcaagggtgtaggatcaggggagggtgaacaagttaggcagaggaatgagctgctctgtgaggtggtttgctccacagcctttcactccttcttcccaacgtctcacagtcataaaaaaaaaaaaaaaaaaaaaaaaaagtaggagggagtgcctatatccagtagaattggagacaagttagggacagagctcagagagctgctcctgatgcggaagtggcaagaaaagacgcttcacctccctgacaacaacacatccactgtgtgtagcaatacgtttctgcctaagacaatttacccccagggaaatacaagaagggagacatctcccaggaaattaccatttgtttctactactgaaggattttcgtctatttatttgagaaaagtgagaagcttctttttgctgagaacatagtaaatgctgcaaaagcatttgatgtcatgtccattaagtaacttggctgaatttcttgaagctttaggtaccttgcttcaattcctgcatactatttactgaccctctgtaacaggacttttcaactttcaactatattagaacatgtagtttctctattaccaagttccagctgaacagtctatctttaatattcagaaagtgtttggtgtctactagccaagactgtagtctgagcaatgacattgacagtggaccttgatcttccttcctttgaagcataagtgccttgtatcattttactttcctctagtagaagtccttcctatggttatagtatttagtttctactttttgcatttaatcggagcatctttgtaatttacaatttttaaatctttttttttcaaggactaaacacgaaggtttgaagtccaacaggcaactaaagatgtatacaaaccccgcacaaatcagcctccattctaatgccattcctcttctatacttccattttttaaacctgagcatatattttgttttgagtcttttcttactcttttatttgttaatactctttattcagtttttgtcaggtaaaaatgttttgccttgccaaagaaccatctaattccttctcaggtctttttaatatattgcttccagatatttttggattggtggtttctgcaattctccctaaaacaatcttcgtttctcttacacatctcattctctacgctttggcagacttttgcagatgcattctataactgcacaaattacccttccaattttctccagctaaacaatctaatccagggtcctaaatatttttggtgccatagactcctttggcattccagaggtgcccagggattttactcaggatagtgtctttaaatgcatgtttaaaatacatcagattacaaagaatgtcaattaaattgaaaaatagcttaaatattttaataattgtgatatagtaataaatgaacttctttaggtgcattaagtaacaagatctactaacagggctaataacttattatttcagtatgtctgtggtttctattggtgacaaaaatcacaagtactgttaatatttttgttttattttgtttaaaattatttaaattttaattaataaaacatatatatgtatatttatggtgtacagcacattgctatatgtatacattgtggcatggctgaatcaaagtaattaacatatgcattagctcacatagttattttttgtggtgagactgcttaaaattcactctcctagcaatttttgactgtgtgctgcattgtttttttaactatagttagcattttgtaaatagtcctcttagaattattcccccaattgaagttgtgtgccctttcaccaacatctctgcattttctccttccaccactctctgtcctgagtaaccaccattctattctctgcttctatgagttcaactttcttagattccacatgtaagtgagattatgtggtatttgtcttctgtgcttagcttctttcacttaatgtaatggtgctgttcatattactgtggttttggtgcctacattcaaactcagtggaaattctaatttgcagttagtttttcagaaagaagaaatgtgtgaatagtttcttatggtccaagcccttggatcctctgtattttatccacagatgcttgggaggatctctagatcccagattaagaactccagctagttattagtcctttgtgctttgaaactcaaatcaaatacccatctcttccatagaactttttctaaattcactagactcacttatctacccttcttcctatagtttcattcactctctgttatgaaatatccatttattatcactattagtttttctgtattgctctcttctttgtaaatatctctatactttattctcttttatttcctttgtatccaggacagtgtctggcatatgcaggcacacaataaatacttgtttaataagtgaattaaaactctagacagcttctggtaagtttttccaggttaccagtaatacaaagacctgaatgttatttattcacttctacaaggggcacagtgtccaagtcctgacctttaataagagatgtgcttccagcagtgtcttcttggcatagtcttaaccttttattctgccctggtgcacacttaatctctcatgaagtcacagctattgatttataactgaatcttcaagatattttaatactttataaacatacaaacaacaattaattgcattgttagataaaaatgtattacagagatcaccagcacaaaaataagtatttctatttataactgaaaaaaaaactggcaatggaatattagttgtttacaaggcaagtattctgaataatgtgctgggagattataaataaccttaactaacagtaaaaaaaattgtgcttacagaaaaaaattatttgagttagtctaaatgtattaaacttatcagtaagtagcatgaattaactactattcaagtgtaaaattctacttccatattacctaattcagttccatatgaagtcagccagcaaggatcagctgaggttggctgttgtgaggtttcagccattatgaaaaagaggagctgggcacagcctctgatgaataataacatggcatgggttctgataataagcacagagaatcagaaaggaaaaaacacagagaggagtatggagaactggaacctgtggaaaatgatacacaatttttttttttctacagagtctcgctctgtcacccaggttggaatacagtggtgggatctcggctcaccacaacctctgcctcctgggttcaagcaactctcctgcatcagcctcctgagtagctgggattacaggcatgcgccaccatacccagctaatttttgtatttttagtagagacagagtttcaccatgttggccaggctggtctccaactcctgacctcaggtgatatgcctgcctcagcctcccaaagtgctgggattagaggcataagccactgcacctggccccacaggcttcacagtcagtaggcccaaaggaagtctggtgtggtcgatcaagaatccagctaattctcgcactctcactgtctctctctttctctcaccttccactgacctctcttccctcctattttgtcttgggaaaaggcaggtgattacaaaattcttctaattatgtattttaattaatataaaatctttacaaaacagtgttaataccagcccactatggtttatattttttgctgtgaaaaaaaaatctcctatgctttagcaatactttttaggcagagagtcatcaaaataaaagagtatcagtattgctgaagtaggtcattcctgctttactttaaaaaatttcaaaacgtttcatttttcctccgtaaaatttatttctatcaaggaaatggggagagaaaaattacaatgaaaaactgtgaggataaatgaggtcatatgcctatgaaatatttggaaaagaattataattatcaacttgttcatttttaataccatagttagatttctcattttaaaaggggaaggaaagaactccattacattctagggattctaggcaagataagtttccatcacagttgctggatggtggagctgggctggtatgacattctttccttgtagaacgtgcgttctaactgaagactagccctttattagaaatgcacattgagaagacaggggatttatgagtcacaaaggccaagatttctaaccttgctacatgtggggcgggacttttctatgctcccaaggacttaaggtcaagtcactttcttcctgttcccgtctccttctgtcttcctctcttttttggttctaaccagaaaatgtattccaatttttcttttctttttctgttcaagtcttacagctctgccaaaggcaaaatgctgcagggattagaaagatgaagcagctaagtcaaatcgatagtgacagccagtgaacgcatgtaaatttcaacaagtgaacgttcagcattgtctctggggcctcccaccaatattaacatcactaaattttctgatttaacattctcacaaaacaggaatcaaccaaccaagtgccagccactaatagccttcaggttaataaatttggtcttcattaatctcaaattagagtcctggagtagacttatgtttgggataggagtgcccatcctacaagaagcttattacccataaatcaggtaagagataagaaaacactcctccaggtctcattagccacttcagataggctctgcagctctttaatgttcaggtggcatgtccttagaagatgagctgagaatcaaagctcctgatacaggaagaagcctaactcagcccatctctcttcttggggcattcacaattatttcctttaacccttgtgtagtttcagttgtgttgattcaagtcattattttcttacacaactagggtatatagtttagaatgtgatagaatcttggaaaaatagcaattccccattatgtatacacacaatacacatacacacacacagtactatatatgtatgtgtgtgtgtgtgtatatatagatcacgtaaatatatatgatatatatagatatatagagagagtacatgtacatatatgtgtataatatattcttcactttcattttatttgtctttatgatttcaggcagtggtataagaagatagaaatagcatatgagcacttcacacagtatctgctataaaagtttattttgacactttacttataactccttgaaagtgataaaattttcctattttcctgaaggtacatttagacaaaaatctcagagcctaatattttgaagtgttagttttgctgaggccaaacaaaatcaaggcccagcatataccccgaatacattctcacttaccataaatttattatgaaatggtattgtgttgataggagagtttttgttacagcctataacatttcagggattttgatagacatgatttccaatgggataacatttaaactgagatagctactatttttttttaatatatgtttagttttgtgaaaaaaaaaataaggaaagcatctggtgattgaacaaatatgtagtagagctaaagacattttccttaaaagaaatatacttgttttatgctttaatggttagagctgttccattatagtgtatcatctatactcttctgatttttattacaagtagggatacaacttaaagatttaaaagtccttcccaaagtataagcatgtgtttaattttcagaatggcagtgagacttacttgcacataaagttaagatacctaggttgtgggcttccaaggatacttccttgggaagtctttagaagttgtttttagttaaggacttggtagcatcaagggaagccatgagtggtgaaattctcagagagactcttctttctgtggtcctgccttgtagatgacattctggagacttttgtgtgtaaatgaatgattgaaattccatagtatatttgtcatttttcctaagcctgtttactctggggaaaatcttctttcatccttctaagttcttactccacactcccgtgggtgctcatgcatgtgtgcatgcgtacacacacaaacacacacaaatatgcatgcacacatcttcagtacttgaggcattaacctgcagaaccataacaccgtgaatatagcagtaaaggcaattatttctgtaaacaggtaacagggtgtattaatattactgttagtacctctgaattctttcttccttaataggatgtattaatattaccgttattacctctgaattctttcttccttcccatcatgctagagccatcttgaatatgacttaagaagtgatctttacattttgcctctgtctcaaactaggttctagtggctattaggggctagaccaaagctaaactgagaataaggttacgatagcacaattgttcataggtggtctctcaagacaacagcattgcaaaagaaggaataattgttatgtttattttacctatgggggaaaaacagtagtccgggcagtctaaatgatgtgtccaccatcatagaataatagagagtgaagctgtaagtataattccggttgactttgtatccagtaaaatgttcattcaacttttgttcatctctcctctagtcacactttgtcatgcattgacttcttggcctgatctcaccagtgaaaacccatgggaacagttaataattccatgactaaggctattataatcctatagctacagtttctccagtgaaataatgaaaatttcttcattaatttattataaaagttactgagtttaattgtatgccatcctggatttcttacagaagtgattcttgataatcctaagaaaattcttcttcagacagattttcaaaatgtttttgtctctgcaattactgttctgaggttagatcttatagaagttactccataagaagccaaagcattttcctcaaagtatagtggctaatggctatgctgttaccaaaagctgtgacagaaaacctctggctattaaactcatatctaatgctatttggcctagctattatgtacaatttgagaaactgatttttctcttctaaaatgaaacacaaggccgtgtgcggtggctcacgcctgtaatcccaacactttgggaggctgaggtgggtggtaatgaggtcaggggatcgagaccatcctggctaacacagtgaaaccccatttcactaaaaatacaaaaattagccaggcgtgatggtgggcccctgtagtccctgctactcaggaggctgaggcaggagaatggcgttaacccagctggcggagtttgcagtaagccgagatggcgccactgccctccagcctgggtgacagagcgagactccgtctcaaaaaaaaaaaaaaaagaaaaaagaaagaaaaagaaaaaaaaagaaagaaagaaatgattcgcattgtagggtcatgaatttcaacacatattacagttcagccccttctctgctgctggtggcacactggagatgtggagatgcagattctcaccacacaaagtggggtccgtcctggaagcttgtaagaaaagcagaatctcaggccctacctagaacctactgaattagaatctgtgttttaacaagatctcttggagattcagaggtacagtaaagtttgagaagcacagctggaaactgtctgaagtctgctatgatcatcttaatcttgggagctgacttagcacagtttctgcctctcccagcccagcctctctgccctatttaggctacttctggagagttccacagtcagaaccttagctatttctgtgcctggtctttaccacacacaggtccaaagatgcccaggaaagctaaatcatagacttccccctactgagcatgttgggctgcctgcagtctctccctttatcataggttggccctctttccacattgccatgcagctttgaatgactgaatgttcaaatttttcacagtgttttcattgcttaacaggacatccatggctgtaatttttcagtgaagcatagaatgtgttaattaaagtggcaatggaattgggacaggttgaatattaaatgtcacttctattgtgaataccatcatgctcttaacatttttattttgttttcatgaagacttagtaagggttaaaagtgggcgcattagtgagctggtatttgcctgcccaccaatgctgattttgatttccatggcgtagttctttggggtcagcatgcatggtgtgttaaatgttaccggggacctgaggaataggagagccctttccttatgacacttaatcctgaattatttatctaaataattaagggcaagcatttttaacttcgttaacctatagtttctgaataaaagagttattgagagctctgactcaaggacaaatgacaaaagatgatccctggagtcagggcatcaccctccataagtctcactggaggtttgcttcctgcacaaggagacatgtctgtgatttgtgaagcattcatcttgtttcacaagactttatgctgcacttaggctaaagtcactgccgaataagtcacttcactatcaagaaagaaggggatggcttttctgggggagcagaggcatattaaggtagaggaggggtggcgcaaagcagtccagccaagaaaaaaaaaaaatcttactaacaggcttagaattaccagcacatgttgatagcagaaagcagattggcttttagccagttttattcttgtttttaaatctctaaagacaacgtacccacttagtgcctgcacttggggcaacatgctcccactcccacctcctccttggtatgccagtgcagaggagtttgttcacacatttaagatattacataaaatacatctctgaaggtcgacactctcagggaagagcaagaaatgactggagcatcttagctgcaagataatgtcttattcagatatctttactctaggattatagattttttttttttttgagatgaagtctcactggatttcccaggctggagtgcaatggtgtgctcttggctcactgtaacctccacctcccaggttcaagctattctcctgcctcagcctcctcagccgctgggattacaggcattcaccaccatgtccagttaatttttgtattattagtagagacagggtttcaccatggtggccaggcttgtctcaaactcctgacctcaagtgatccacctgcctcagcctcccaaagagctgggattacaggcgtgaaccactacgcccagctggattatagattttgacactcagattactttggctggtctagtaggcaaataatgacaagacatgctcctgccaaagatgtccatggcctaatctccagaacctgtgagaatatgctacattgcatggcgaaggggaagggagactgcagatggaattaaaatagctaatcagcagataggaagatcatcctggtttatccatgtggacccaatgtattccaaggagtctttaaaagtggaagagggaggcagaagaagagagacagagtaagatgtgactaaggaagaatggttaaagaaatgtcgctggtatcagagacaagaggaggaggccgtgtgcttcctcttcatgtgggctatgcatattctcactcataggtgggacttgaacaatgagaacacatggacacaggaaggggaacatcacactctggggactgttgtggggtggggggaggaggagggatagcattaggagatatacctaatgctaaatgatgagttaatgggtgcagcacaccagcatggcacatgtatacatatgtaactaacctgcacattgtgcatatataccctaaaacttaaagtataataataataaaattaaaaaaaagtcaaggaagtgaattagaggtccctagaacctccaaaaagtaatgcaaccctggatggcatcttgatattagcctggggagacctgtgtcaaacttctatcctgtagaactgtaagataacctgtgtttttcttgtaaaagatttcaacatttgctttagattcagggggttacatgtacaggtttgttacatggcatcacctagatagtgagctagtacccagtaggtagttttcctgcttttgcccccttccgtcttccccctcagtagtccccagtgtctgttgttcccatctttatgttcatgtgtatccaatgtttagctcccacttataagtgagaacgtgtagtatttgattttctgtttctgtgttaatttgcttatcaacctgtgtttttaagcctttatggtaattacttatggagcaatagaaaactagcacaatagataaagtcaaaattggtatggtatgtagaacctaacagagcacggtcctggctccacatctgattagtaatgtgcaattggtaaatttctttagccttattatccttatctgtagaatggacataataatatttaccttatggggttaagagagaatgaaataagaaagcaactataaaatgtctgggataatgcctatcagggtggggctgcccaaagatactaaatttgattttatttctttcctcttatacaatttggtggccctcttagtgagtggccccatatcgttaaggcttactgctaactggcccccctgagtccttagaaatatcaccacatttattgatatttcactgtgttcctctgagaacctcatttggccatatagtcttctaccaatcactggagttttcattagtgctagattggcattagacacatggttatagaaggatctagtagattattattttgtaggagacatcatcagtgctcatgttaaatgaatgatacattctgttgaattataaactgcctctcctacacctttgtctttgtacatttcagtccttcttctctattcaaaactgacgaagtaaatcagttgggaagaatacagtaatttatttgaataaacatttgtcaacattgtttaggaaaataagttacaaattgactgtatcgtcatgttcctgcactaagaaagcattaggagtctgcctaaatccttttatcaaaatgtattattattattattattattattaatttttttctatttactctttcttttttaaaaaattgctctcctctagatattttttctgccactctttataataaaggagacaatatttctaactgcccaacagacttcaagatgatcttgacagcctctgtagccaaattatcatattaatttgatctcagcaacacttctggttcactctgttctgtactcaaatccaaatcctgagctttttcttgagcaaataaaggcaacagctgtgaggtcccagttcatctttccggttttacccatacaacaacaggctgtgcaaagttgtgagcaattcacacatagtgctctcaactctatttttattaagtactctgaagagcaagcaatcttcaaactcctataaaatttcatgaccaaaacagctatcgggatggtgtttcccttgaaatgtctctatgagtacagtcatttattattctaggcttcctgataatccttattagtggataccagaactgtgattttaccgtatttgcaacctaatgagtaagtctaccacatgaatgctggcagaagatacaagattcctgggtcagagatgaaggatagtttattgctacaggatagcagaataccagcatttatgccagtccctaaaatttaagtcccatggggcaaagggaagagggccagacaatgcctgcagatgtaataggggagagttgagtttagggtacccccaaattttataataggcagtactttggtccagataaagacatgttttttatactggatagtagacaaacatccatttgctccagttggagacaatacttctgtcttcccatagatgttcactgtgcaaacaattcttgaaacaattgcctggaacaaagttatcagttattagattttttttttttttgagttggagtctcactctgtcacccaggctaaagtgcagtggcatgatctcagctcactgcaacctctggctcatggattcaagagattcttctgcctcagcctcctgagtagttgggattacaggcacccaccaccatgcctggctagtttttgtatttttagcagggacagggtttcaccatgttggccaggctcgaactcctaacctcaagtgattctcctgccttggcctcccaaagtgctgggattacaggcatgagccaccacacctggcccaaagttattagatcttctgttcacaagatacacagaaatgtgagaggccataacaagttgtcaccctacaatgagtttcttagatgtaaatcgactcttcccttcctatgttggtaagaattgtgccatatgaaacatcatcataggcatatgtaatgttaagcttttttgccgtaagagaaaatttttccttgcttccttagcagaatacaggcttcagttatgtgatcaacctgtttggatctgctaggttaaactataaatgcatttttaaaaatactacagatatttcactggacaggaaatggggatggggaagacagaggagagagtgtatggcctggtaacaaagcattaccctttctgttgcacactgctgcccattttaatgttggccagcagccaggacaaagagccaaggcagctccaaaggatctcagagttggaggcaagagagagtcaaggaagctcccacatgctgaaatgtcaaacctaagcagacctggcctcagagtacaacacaatcagatcttccaccatcagagtcattgatagccacactggctcccttgctgtttctggagcacagcagacatggacccacttcaggtcctttctgctggctctggtctgtcataggtacactccttcacctgatcacccagggatcgctttcttatttccttcaagccttcttcatccaagtactgaccaggcctcacactgcttagcttccgagatcagctgagatcaagcacgttcagggtgataaattagttcaatcactgtggaaagtagtttggtgatttctcaaagaacttaacacagaacaagcattcaacctagcagtctcattactgggtatatatccaaaaaagcacagattgttctaccaaaaagatacatgcactcacatgctcatcatagcactattcactataacaaagacatgaaatccacctagatgcccatcaacagtggataggtatacatatgatacgtatacaccatgtaatactacgcagccatacaaaaggtatgaaatcatgtcctttgcagcaacatgaatgtagttaggggccattgtcctaagtaaatcaatgtaggaagagaaaaccgtatgccacgtgttctcacttttaagtgggcacaaaacattgggtacccatggacgtaaagatgggaacaatagacactggggactactagatgcaggaaggtgggaggggtgaaaaagctaactattgggtaccatgctcggtagttgggtaatgggattatttgtatcccaaacctaagcatcacataacataaccaagtagcaaccctgcacatgtaccaatgaatctagaattaaacttgaaaaaaataagtaagtaaaacataaaacatatagatttttaaaaggcatcttcaaatgtcaccttgtagtgccccaccctgaattgtagtcacctacacacataaactcacacacaaacacacactcccatacacacatcaaaacattcaatacacctaccttactctatttttttttctgacttccaacatagtacatcatttatttaacaagaacgtaagctcaacggggaggaattgttctctgtttattttctgatgtttcctaggtacctagatcagtgcctggtgcatatataaatgaatattttgagtgaatatttgtggaatcatgaatgaatgaactgatgaatgttaatattggtatttttcattgttatttgtcttattcctaggaagacaggactagtcatttgaggtactttttcagaacagccagggctggggaggatcctttatttgtgggtgttaaataatagcaagtgaacacagtgcagcagtagtgaccctgttgatgatgataatgaatcacattgatatagtgcttttctttttctacctttgtgtgtgtgtgtgtgtgtgtgtgtgtaattctcctcagtgtcagggtgatagattatgcccattccttctaggaaaatggttattccatcttaatgcaggcttttagaaatgaaaaataatgcctgctacaatcaacttttaattatctacactaatggagtgctgatgctaaagaaataatccccaagtcatttacatttgactttaggatgcaaccgagggcttgtattcagaaaagcacgttaaaccatcgtcagcagcatgtgattgcagaacaaattctggcctgggagttgggaaactggatttggtagaggctcggtgttatgggttgaattgtgatgccgcccccctgccaaaaagatacgttagaatcccagcccccggtaactcagaatagaaccttatttggaggtagtgtcttgacaaaggtaattaagttaaaatgaagttgtttgggtggaatctaatccaatatgactggtatttttatagaaaggggaaatttagactgagacagagacatgcatacagggaagaatgccatgtgatgcctggaattatgctgccacaagccaaggagctactgcaagttagcaggaaggcctgggacaggcccttctctagcacctgcagaggaagcagccctgtggacaccttgatctcaaacttccagggcagtaagacaaccatgtctgtggtttaagctaccccattcatgggactttgttatgacagcccttggaattgaatatgcttggtgactcaactcttatgtgctcatctagcatacagttccctctcatctccaagcctccgtttcctcatccctaaaatagaatccaaagcccctagctgtttaagggctctataattagaaagcttctgacagaaagtccccatcagctcctcccagtttagcagtaaacccatccacctaggtgtcctctaaattaggtaagtgaccctagaagaaagttccacacatcatctgaaccgcggataaaatgcatgcagaaatgactttattcaaattcaagagtttacattttacttaactctggaaaactcagagtttaaacattttcacatttttttttaaatagcaagaatggcatgccacatcatgatgattcagctctcatctctatttctctaggcagaatgcatttacacatcatccaatcccaccctatttccatgtactattagcagaagcaaatatcagccttcttcaggccctggcaggataaaaattcagcccagtagacactgggaggacaagaatgaggatgtgacttacattccccagggccatggcattcaaaaccaccatacccactgaatgtgcttctctatcgctttgtttaatatttggagagtagtgtttgctccaaaacttgtaaaaagtgagaccaatggaaaccattggtccaaagcaatcttacctgagaaacattttaaaaagaagtctttcccttatgattcctcttcttactctacttttttgaataaagagattaatacccaaccgatgactactgcaaggatgaaggttattctttaggagaaaaaaaaattgtaacatacatttttatgaaaaaaagatttctaaatatgctgataaaatcactgacatctcagtaaatatagtttattcctaggaagtgactagaatgattgatttagctatatgtaagttatttaatactgtttgaaaggtacttcatcaacaccatttactgtgatcaatagcattttcaggaacacttcagacttggggaggttactcctttgggtaaccttttaggattatctgttgtgggaacaagaagtagccatcaaaagccactgagcaggctgggtgctataatcccagcattttgggaggctgaagtgggaggactgcttgaacccaggggtttgagaccagcctggacaacatggtgagatcccctatctacaaaaactatattaaaaaaatttagcttgttgtagtgtacacacctattgtcccagttgctcaggaggctggggtgggagaatcacttgaccccaggaggtcaaggctgcagttagcattgcttgtgccactgcagtccagcctaggtgaaagagtgagaccctgtctcaaaaaaaaaaaaaaaatgtccctctaagcagttaaaataggtcaacatcaaagctcatggttctggctcttagtcaaagcctatttatatctgacataattctcatatattgcatatattgacctgtttggtttactaatccacattagaggccaacagtatagaaccagaatcagaaaatctattaaaaggaaatgaaagaataaaaaagcatggcaatatcaggccattaggtgtgggtacaaataatctcccaaaccacagtagtctctgagtgtttcactgacaaagtttagttatcgataattataattatgaccttgaaatcctagcgtagacattgaatactatgtttggaagtcagggaattgtttaatatatttaagaaagatattcccttcaaagcagttcaagtggtcttagtattgccagttaaggaagtgggttacaggatcctggaatgactcagtgatatagaaaggctcagtccctggcaatgtcagatgagtgaagaggttgatgcaaaagtaattgtgatttttgccattacttttaaatgtaaagtacaggcactaacatagtattagttactaatagtattagttatttagtaaattacttttgtactaacctaatactatgttagtgcctgtacaaataatgtgcagtaaaaacaatgagtgtgtgtgtgtgtgtgtgtgtgtgtgtgtgtgtattggaaagcagttgatctgtacacatacttacagtttactaaacaaatgtttgagtgcctactgtgtgtcttgctttggctgtgctctagacagtcatgataacagagatccctggtctggggaggtcccactctcagagcaattacggaagaagggtagaggaaatcatgcaagtatgtagggataggctgatgagagcggaagcatgagggctgagagctgcaggctgtcttcccactagtcagggaaggctttctgattaaagaaaattttcatcacctatgcttagaagtttagactcagaataactgatggcaaatggaaaagatgaaataaactaggatgagaagacaagactgcccaattcacacaatgaatccagtctctgaatcagtcgggtgctagccaaagcagaaatatttccagcagagccctgggaacagagaaggaggcagtttttattaaagtcttagtttccaaatgatggatgccaacaagaaaatagtttaaaattccaagagaagccttcacctttcattccattgtagagtaatggctttttcaaacacattcaaataaagccagggttgttaagtagtatgtctcaatcaacatactcaaagtctgtgaaccaaaggcatagtcttaggcttcctcttatagtctagcatgatattattctatttcatctttttttatatgtttgctcccttgagtgttttagaatgagactgctagattttatgtttctaaagctggttttctaccaggcctgttctcagaacattcttttttttttttttttttttttttttttttttttaagatagagtcttactctgtcacccaggctggagtgcagtggcgcgatcttggctcactgcaaccttcgcctcccgggttcaaacgattctcctgcctcagcctcctgagtagctggaattacaggcgcccaccactaaccccatctaatttttgtattttttagtacaaaatgggatttcgccataatggccaggctggtctcaaacacctgacctcaggtgatctgcccgcctcggcctcccaaagtgctgggattacaagcatgagccaccacgcccagcctagaacattctttcttggaaaggaagaacatcacagccttctgtgcattctcttgttcacccacataggcaaggtgatgtgtttgcagccttctttttaccctcacctctgggaggtggccttggctcatcacctattgtttcatgctctctcttaaaggctgatttggtgactgaattcatcattgctgcctacacacccatggggctagcctgggcaaaatgtgcctcgtaggttgcctgaccttttgccttttggcaacgtttatcacctctgaggattcagcttctttcgtcagaaagtgagaacttggatcaggtcatctctaaggttcctttcagttttaacctttcagaagtcacacaaccataaacatttggtgtacctagactgttggcttattgtccgactttaagccagtcatttcagttaaacaaacaaaaatgggggcttgccagagtcaagtcatacaagactgctttcctaatatttggtgcttcttaaatgaagttgttatttatgcatccctcaatcccctccctcttctgcatattttgaacttgcaaagccttctgatattttaagcagaaggttgcaaatgcttgtcctactgcctggccaagtcttaggtaaaaattgtcacctaaccacatcctcagatcatttcccctgtactctagatcactaagcgcatgtgcacacacacgcatgcacgcgcacacacacacacacacaccatccaggatcctcctgaggatgaatgaatattcctgggccaaatattgcatgaggatttgggcaatgttttggctagttgaacaacaacaatgctcatatttatgccaattggcaggaccattgcttgatcatcctgtacttggtgaagggcattttttattgtttccttttttgtttgtttgtttgtttgttttgtgaggcagaatatcaccctgtcccacagactggagtacaatggcatgatcttggctcactgcaacctctgcctcctgggtcctagcaattctcctgcctcagcctctcgagtagctgggattacaggtgcccaccaccacatcgggctaatttttgtatttttagttgagacagggtttcgccatgttggtcaggctggtctcgaactcctgacctcaggtaatccacctgcctcggcctcccaaagtgctgggattacaggtgtgagccaccatgcctggcccaagggcattgttttctaatccagataactaagctatccttagggtgatatgtaatgcagcaattgctagaaaatgacatgttttcataatggatctttctccaccatctagaaatttaggtaaagttgaaagaaaggataggaggaaccatttactgtgcacctactttcttcctgagattttatacatgtcatttgatgtttacaccaagtttttgaggtcaatctcatatccaaagctctaatcaattaactttaaattagttaatgacagggctctcttattcttaaacctgtcatttcccctaaactatgttgttttcctaaagtgagattaaaagtttgaaaacaaaggaacaaaatgttcatttatttactacgtttctgaaaacttgcatatatcttaatatatatatatatcttatttatatgtcttatttcattgttatgaaaacctagctttctttccttctatcctttcaatattatgctacttgtatttagtatttacattgtatgattcaaaatattgttcactgcagagccaagtagtagactatgaccgctctgcttattttgaacaatcttttatttttttctggagttgataattgcttcagatttttgtctggctttttataagcctgttgataatttcctgtttattctaatgtctgtcatatgcctatccatggagttaacctagtttcattttgtttttcatggccacatctttatcctcctttctgtgggggccctcagcttctgctttaattccagctagatactttctgctttcattcccgctatatactctaattccagctagatactttctgctttcattcctgctatatactttaattccagctagatactttctatgtgggctgcaaaggtgtagccctgatacttttctcatctatcatcctgagacttcatcttacaattaccctgttttccaaatctcatgccttctacttccttcctttactctccatttagaatatttttcagcagcttctaaattagcctacataagacataaactcttagatcttacttgtctgaaatgtctttcacatatgattggtatttgagctaaacataaattagagattgaaagtcatttctcttcagaattttgaagacttctctactctttttctttctgctgttgtttttgagaagtccaataacatatttctaatcctttgtattttgtttcctctctgaaaactacttagatattcttttattacaaatattctaaaatttagtaatttttaaaattctctcattgttttaaactttttttttgagtggagtttcactctttttgcccatgctggagtgcaatgacacgatcttagttcactgcaacctccgcctcctgggttcatgtgattctactgcctcagcctcctgagtagctgggattacaggtgcgcaccatcatgcccaactaattttgtattttttgtagatacaggatttcaccatgttggccaggctggtctcaaactcctgacctcagatgatctgcccgtctcagcctcccaaagggctgggattacaggcattagccactgcacccggcctgttttaaacatttaatggactcaccagggaattttcttgtcttattactttgataatttcctccactccattttccctctaatatttttactttcggggattcctatgagtttgacattggttcttctggactaatgtttcctctagtgttttttgaagatgtctttttggattaaattctagaaaccgcctcaactttatatttcattgttgctcttgatggttttaatgcagatactgaatttccaagagtgctttagttgttctcttagtgttcatttcatagagcacgttgttctcctttaagaggtcatatcttctctttaacttccaggatttttttaaccgttttgtctgttctttatattatgttacttttctctcatttgctccacttcctccccaccccacccctgtttatttagatctcttcctttcatagtgaaggttcttctcaattcactagctacctcaactgtccctttgtatttgagaacaaggcattgagaagcattattttggaagctctgtgtgcatgaccaggacttgtcaaagactggagcttatcacaaggggatcagatagaaagctgtcttttctataagaggcattcccaatgttagtgtctgcaggccttctagaactggaagcagaaagtccctcctcggcatgtagagtctcactcattcccgtttgcattccatcacctccctgccctgagccctttgcacttgtggtacatgttgtttgaagtatgatgcttcattgattagattccttcaggggtaaaatctccattctcgtgtggggaaggtgatactttaagtcacctggctgtgcagcaacagagagggaccaggtagtctaataacaccttatgcagacttccaactcttgtttctcactataccttattctataaacttctggggaaacggctttctttgaattctgagcctttcttaggtatatttcaggccaacttacttgtaccttgtccatacacttgtcaactggcacccaagttcaggcagtctccattttaatcaatcagctgctgctcatccacctttcattttatcttccaaaatattgttataattcttatgcattggttagcttcttttctttaactttgtccttgtggattactactcattttggtcttttattgttactttagtggcatttcaggaggaaatggaatggaagtgtgaggtcaatgcagcatatcaaccagaatctagcctgaattgcaactgtctcacaataggtgccggactctgcagttatggttctagatagtacaaaatttcctctctcttatgagaaatatgaaatcatttaaagcagttaccttttctaaacaattccatggactctgagtcaaaataatttggcaatcatttattccaacctctcctggatgcctaaactatatccctaagaggtgattttacaatcttgaattgaatctctccagtgataaggaatttacttacacatgaaatgattcattacattttcaagtcatgttgtggtaagagttagagtgcttctaagtatctttgttaactcctaaaatctgagtcttacaaataactgacttatcaagttgtaaaaagtaaagagaaaatccccatttctcctactttaaatagaccgtagaaaataatgatgtccaaatttgtcaaatacgtcaaactcaactgcatataggaccattggtgtacttataatccaagaagtgccaacacaaccatatggcatcagttgaagggacctcaagaagttaatgtggatttcacagtggcaaggctgatggctttagtcttgctgaaagttctgcttgtttgatgagaaatatttatataatattttcagaggcttatttcttgtatgtaaactctcagatgtgaaagggaattcatttgctgcatattgattagctcgttgagtgttaatttctcatggttgtggtctgcatgagagaactacaatcagctagagtcaaagaaaagtggatgcttccaccagctgatttttattttatttttatttataatatggaacactactgtaaaagaatctttgcctgtctttccactttataattataaagaaaaggaaaaaaagaggttagagggcccttcaaggtactttaaaatgtttttttcttagcaattcaaaatgtcctagtgaaacgggagagttccctgactcccttcacaggacttgtgacaggggtgtcttgtttatttggcctcagtgctcaaaccccttatgggatggggaacatgcaggtgcacaggagcagaagccagggtgagtgcttttgggctccagccccacagtggtgtctaggggtgttacaatgctcttttagccctgccatctggagatggcttaagtgttaaacagctcagtgaaaagtcagtgtgacagccttttggggttcccatacccagtgtgtcctgaattcttgttcagtgtccatgaagaatgaggtcatacagacctgaaggctggtgaatgtggggattttgttgagtgatggaggtggctctcagcaggaaggggaacgggagaggggacggagtgggaagatgatcttcccctgtagttcatcggtcccgtagctgatttcctctctgtccacagctaaactcctcttgaccttcagacacttcctctcttccctcctctgctgcactgctctgctgctctgccactcttctgcttgtggagcctggatattggggtttatatggatgggcacacgatagggggttgcagtgggtcaaaaggcaacatttgggtgcaaaaacaggaatgcctgttctcacttagggctgcaggtctacgcttgagggtggaaccctcgccaggaactcttttgcctcctgtccatatcactaggaagaccattgatgtgtttgatctttgtaaaactacatatgactctcaagttgcaagtgatactgtggttcagcttatcaaatactggaatttggcttctgtcactgactctgccactggctttgtggtcctgaacgcagccctgatgtcagatgtgttggtaatcttggggaactttaagcaagccagctttttttttttttttttttttttttaggactagatggaggtaagggaaagtgtgagacaataaaactggcaaccagaaacagaagaagaaaggaagagagaaaggaatctacggagtgtggaagttttaggagtaaatttctatataagttgcaaaattttagtaattctttagttcttatttcatttattcacttattttttttttctttttagacagagcctcactttgtctggagtgcagtggtgcaatcttggctcatgcaacctctgtctcccagcttcaagcagttctcctgcctcagcctccccagtagctgggactacaggcaccagctaactttttttatttttagtagagatgggatttcaccgggttggccaggctggtctcgaactcctgacctcaagtgatccaccttccttgtcttcccaaagtgctgagattatagacgtgagccaccacacccagcctcattcattcatttattcattcaacaagtattaattgtgtgcctactataggccaagtgtattttgggccaagtgcatttctatgagctaaggatatagcagggaataaaacagttacctccatcctcatggcacttacattcatgtacctgcaatccccatcagaatcagcaactaggaagagatgatatcagagcttgaacgtggatccagtaatacccatggatagttctgtggaagtaccacagagaaaaattcaaaggaaagaggaataggatatattgagatacaaaaagtgtagcaatggaaaatcaggtgatcagattattgagaatgaaatatctttagtaaagatttgaaggagttgagtagagatatctcctagatatctacacctacatagaagatcatgccaagaggaggagcagcatgttcaaaggagagaatgggtatgacatgtttgaagaatagtcagtagtttggtatggctacagctgactcagtgagatgggaatgaggtcagaaagatgaggaaagggcagtccagattgtgttgggctttgcttgcaaaaacttcagctcttacttggtataagacagcaaaccattgaaagagtttgtgtagaggagtgacatgatctgacttcttttttaacaagatggctcttattgtatcattaacagcatggttttacatgaacctatcgttttgtttagtttgtgggtcaggactgaacaatgaaagtagaagcagtcctgtgacagtggcactaattacatttattgtcatagagaaagctcatgccagtcacatactagtcagaggagttttcagtcctaattgccacagaacaaatgactttggatgttaaatggactatagtcccctcatttgcaaagtggggatagtagtatctatatagtgaattatgagaagtaaatgagaaataacatttgtgaaaatgtctgacaaaatgcctgaggtgttaacggatcttttaaaatgttaactgtagcctcaatggattgtaagaatatacacatttaaacccattgacataaattatggctagaatgaaagttttgatcatcttgatgatagtttttgtcttttgggtttctttcttgtgtgttctatctgaagaaaatcatctgaaatccctcatttagaaattgaaatattttatgtcagcaagcacatatgttaatgatttcctgaatcagaaatgtgttcaaaatcatatctatagcaatgatcaccacagcggtagttctattagggaaaatacacgaaaacaaatataaaacaataacaaattaagtaactaattaaataatgtgtggcatggaaataaatgaaatactgtgcaaccttcgaacaccattttatagaacaaataatcattggagaagtagacgtgatatgttgttaagtaaacatatcatataaatggcttagaggcttagagatgtgtaggaaaggaaatactctaaaatgttaacaagaatggtatctctggtgcaattaaaagtctttttaatttggatgggtttttttatattttacaaatatttctgcattgattctacattacttatgtaatcaaaggtgcccaatacgtgttacttaaagaatctcttcaataattagaacgtaggcactcaatgctcatttttttccccagtgattctctgaacgtgtgttactaccatccaggagcagaactatatcttgctgagacatttgtgataatgacaaaacgtttcaatcagaaatttgagataaggatatataaatgattttttctcatgagaaataaaacgcaggtgtgttcaccaaaatcctgctcttttactcaatccccttggccaaaagtaagcacgacctctctggcattgtgaacaaaaagaggaattaactcaaaaagactaattttatgcattagatgatcctttagaataatcaagcatatgagtattagggtaacttatcctttttacttttcctgagggaggtaagagtagcaccgacttgctactgctaaagatatggactattggcctgggagggtaagcattttctgtctgatttaattaagaccactacctgctgacaaggctttgagaaagaaacaaaaataaggaatgcacaaataaaatgtaatgcaggtcaggcatggtggctgatgcctaagtgggaggcttaggcaggtaatcacttgaggccagaagtttgagaccaggctgggcagcacaccaagaccatctctctacaaaaaaaaaaaaaaaaatacaaattagccatgtgtggtgatggatgtctgttgtccagctagtcaggaggctgaggtgggagaatcccttgaggccagttcaaggttacaatgagctatgatcatgccactgcactccagcctgaacaacagaatgagaccctgtctcattcaattctttaaaaatctaatgcaaaaacattagaactgaaactagaaccagttttattggaagatgatggaaaagcaccttgtgatttatctcttttggtagcagagagctcatgatcgtccatctaactcccacaccatcttggagagccacagggtatcctacattatcctgctgaagatccttcagtacctaatggctctcgtgaagcattccaaagtgaaagtcatggagcctatgccactaaatcagatataactagatacatgttggattaaaaggaaaggaggaaaggcatagaagggaaaaacagagattattggagaccaaatacctctataaattctcaaaatttgtttaaaggctttactttttcaagatgcatattttggcaatagcttacgaagactgaagttttcttatttaatcttagagatactaatacttagaaaagaaaagtcttctatcttgttgaccttctctgtagccatttgaaatcttcattatcagaataatgcccctccatgtccacaattattaatttttatagatttagggggtacaagtgcagtttcattacatggatgtattgtgtaatggtgaagtctcggctttttgtgtagccatcacctgaatatagtgtacattgtacgcattaagtaattcctcatccctttcccacaacctccacccttctgagtctccagtgtctataattccactttctgtgtccacgtgtacacgttatttagcagccacttataagtgagaacatgcagtatttgactttctgtttctgagttattcatgaccagaattattattctaattattgtgaaataaaaattatgcctgactaaaatgactgaatccagaacttcaccataatccatctatctcctccgtgagtcagtgcatattacctattccaatgacctcttcagtactgtaaatattactgtgttccttttatttacttaataaatagatgtcaaatgtgtggaaaacaacatttgttttttcaaatacatgtttataacaccctttggaggaagtaagcctctagaacatgacagtctctggggtatgctattttcaggtaattttaaatgtcgctttccaacaaaaatgcaatactattatctttttttttaatgacaaagaaaagcaaaacaagtattatattggtgcaaaagtaatgcagtttctgccatttctcttaatgccattactcgtaagggcagaaatgaccattacttttgcatcaacctaatacctccagattttagatatttgagtgccattgcttgatatatcttttgttttttcttctggaaattttggttactttagttgcataaaggatgacttccattttaccctgttaagcatctctgtctggtcagaagctactactctgttctttctagttcagtagggaacaatcagtttccttctcaattttcagctaatctttatgaatgaaatttgattaaatctagcaaaactatgcaaacatcataacagcatatggggagccttcctgtagtaccagtgggctatttccgtctaataacagattcaaaaaatccaattagacagtttgaaaaaagaaagccagagttaaaaatatctgactgtttgactgagaacagcagggaatggtttataggccaatcatttatggtgaataggatcttagtggtgagcaactcacatctctagcccattagaataatgtgttactcatattgctcctaaagctttctacttaattataccaagttaaatagcagacattctcactcccttttgatggaaaatcacatttattcacccacacaataccatccttgggtgttaagggatgagagttgacctaatgggaagacaaacaaatggtttaggaaatgagacatgatttttttacacaaaggttaatgcacgagaaaagaaatgcctaggtctctgtctaatgtctatgtgttctcatcgaataattcttaaatgaccctatttagtttgattttctaactacattagaaatatatgaaacaattaagaaatcattttttacctgtcatatggcagatggactaacattgatcagggcagtcgaggaggttgtaaggaaatgggtactctcaaacattgctggtgggactatgaagtgttttaattttttttttttttttagacggaggtttgctcttgttgtccaggctggagtgaaatggcgtgatctcggctcactgcatcctctgcctcagcctcccgagtagctggaattacaggcaccctccaccatgcccagctaatttttgtattttcagtagagacagggtttcaccatgttggccaggctggtcttaaactcctaacctcaggtgatccgcccacgtcggcctcccaaagtgctgggattacaggcgtgaaccaccgggcccagccaagtgttttaatttttaaaaactatttgaccatatgaaaatatagatgttccattaaatatatatagcctaagaaatataatcagcaatgcagtaaaagattatgtatacggatgctcctgacagttggatttacaatagggaaaagctggaaacaacctaaatatttgaaaaaagagaatggtaaatacatcaaaaatacaataaatacagtgttaagtgaaaagtttgtgcaattttgacttgagaaatttttaatgtactatgactacttggaagaatatggatgtacctcaaaataagtaatgatctatatgaaagactgtttttgataatttttgttttcttatacataccttccaatattgtccaaattttcaataataagcatgcatagcctaatatatcatgtagatgagtgcaaaatgaacacagagattaagatcatgggcttttcaatgaaggtctgagtttgaatcctgtctctgccatttactagcaatataatttcaggaaataacttaacatctctgctcttcagtttcctcatctgaaatataaggataataatggtatctgtgccttaaggatgaccaaagttatagatatcttaagaatgaattaaatgcgtttctctccatggactattttaacaatgaatgcctgacatagcaattatgttccataatcaccattatttatttataaaattatttagtattatttaatactaacattctggttttataaaaccaaattttaaaaatagataagtaaatgaaaggacaaggaaaacctaatttcactgtttttctagctttttttattgctataacttttatatcataaatccacccatttgaagtgtatagctccattttactatactgttttcatttataaaagccttttataaatttatacatacctttcagtgttgtttgaattttccatagcaagcattcatagcatagtatatcatgtagcagggtttaaaataagcatagaagagggtttcgccaaaagattatttaagaaaatctactaaaagagggttcttctgaaaaataaaatgtatttgcttttatcaaatgagcaaacttcatccacttggagatcacccacatgtgaatttctttctttctttctctctttcccttccttccttccttccttccttccttccttccttccttccttccttccttccttccttccttcttactttctttctctgatggtaagttacattagaggacaggaaggctcagtgatcagttttgatgggatggctgcacagaggcacatggagaagaagcaaggaagccaccttcagcttctgggtctctttgttatacaggaaaggaagtcaactggggtaaacctgtttggaaaggattgagtccttctctcaattttgaagggatgattttttagttcttcagatttatcttctgtaaataaatttcttcagaagcttcctgcaatatgataaacacaaatgattaggaagtgttttgtaaggattggggactaaagaaattattgatgaagccagaatgtgtcaaaaaggtgtcgtaaagcagcaatacttaaacattttggtctcagagtccctttacaatccaggacccaaagaggtttttttgtgtttgttttttgtttttttctaaaatgggttatacctatcatttttttcatattagaaattaaaactgagaaatgtttgaacacaggaatacccaagtacatattccagtgatcagcagagcaatggcatcatcacatcatattgcctccagaaaatcccactgacaatttgttgaagactaaaagggaaaaagccaaacaccttagtatgctgtaaaaacagctttcatctcacagacctcccgaaagggtcttgaagatccatgagcaatccctggaccacactttgagaaccgcttttgtaacgtgtgaccttcccttatcctctgccatgcgaaactatctcagaatctaagattgtctacagccacggtacaaccagctctgagactttgaagagaagaaaagatgaacttcatcactaaaaaagccaaagtagttgaaagcaaacactagctgaattttcttcctccaagcctacagaccacctcacgtagtagctgtagtgggagctgctcccaagatttgataagaattagtaaagaggtttataagaccgtgtgtgcagagtctcacagttgctgatacttgttgggcttagctttatctctgtctacagtagcagcccaggacaaaacattcatatgatattctctctttcttctttaaccatagataaatgtcccaagaaaagggaagagaaacagaaaaatcatacatgctaaacaccagtttattaaatatatttgttgctgtttttcttttttacttggttgctcacaatattaatacaccctctttataaaacatgaaagcaatacaaaagtataatgagtaaaatgagaatcctaaaatgttttcttccataatcctctctctaatcgcatttctcagagataactgtgttagcattttggtgtgtttcttatagccctttttgttgtcaaaaataagcaaagataaaggggaaagattttgttctgtttcttttttctatatacacagtatatcttggagatagtttcaagtgccaaatacatgcatttatttttttcacagaatgcaagtcatgtcatagcatggatgaagttgggtttatttaatcattcactagttggcaggtatttaggttgtttacagtttttccattttagaaacagtgttcccatgtaaagaatgtcccttgtgcataaatcgttgtgacatgtgttggaatctcaaaagtggaattgctgagccaggggcatcctcattttaaaatttaatagacatcatcattatcctctagcatgcacatcactttacacaactgatggtaatttatgaggaattctatgtcccctcactccaacactgcatctagtcactctttgaaaattgtccagtctaatgggtgaattatggcatcttgctttgttatgcatttctgtgattaccagtgaacttgaacatctttccatatttttatttatgtttaacatcgaaacacgttacgttttgaatattttcctctactctattactgccttttatccttgattatagtttcttccatcacacagcaggcttgaatttttgtgtacttaaatttgccaatcttttcatttctggttcctgagtttttttgtttaacttaggaaccacctcctcccatactatctccaaggatagaaaaatactgttttctcctagagcttttgtgaactttattttttacaattatatctttagtccattgatggctgtgccttttaaataatgaaaagtccatatttaagttatttttttcccaaatagataaacatttgccttacaggatttagtaagcattttatcctttcttcctacatttgaattgccacctttaacacagggatattaggtaacttaagaggtaaatgtgtgtttcttgaatcccagatctaccacttaaaaattatgtaaggtttgatttactgattcatttttcctgccccaccaacttcatgaccataaaataggggcaggggagaaggaaatgataagacttagcatattataccatatggaaattaaataatacacataaaatacttaaaatagcgtcaggcaatttaagagcactcagtaaagttagctcttattaaatttttgcaactccatgtatacctgggatctgtttctggtttgttcatggcagcattgtcaactaaaactttctgtgctattcagtgtgatagttattggacacaatgaccactgaaaacatggctagaatgatgggaaaattaaaattttaattaattttaatttaaagataaacagccacatgtggtcagtaagtaccatattggacaggagaatgcccatatagtattttccatgagctttcatgagttatgctttattatataaaccagattttatttaagaactcatatggactagattatgaattttatgagatgattttccttgagtcatcaagaagaacacagtttttttctttaatctgttaaagttgggaagtattaatataaatctagttcctacttgaaatcaacattccagcaataaaccttattggttcttgttattctttgacctcacggttaaatttgatttgctaattttggttagagctcttctatattcatatttgagattattttaaatttgcattgtgcattgactgtgagatgagtattttgttggcttggtaaaatgaattaggagacttcatattctaaattctgaaatagtttgaatattggagttattatctgttcttgggagatggtttttatcaccagttcccctaaactcctttttaccttgaggtaaagcaaagtctaccttactatttcttgtatggtgattggctattcaggttttctatctattattaagacaattttgaactcactggtgctccaaagaaaatctgaatcattctattacaaagatacaggctcacatatgttcactgcagcactcttcacaatagcaaagacatggaatttacccaaatacccatcattgatagactggataaagaaaatgtggtacatatacaccatggaatactatgcagccataaaaaggaagaagatcatatcctttgcagggacatggatggagctagaagctattatcctcagcaaactaacacaggaacagaaaaccaaacaccacatgttcttacttataaatgggggctgaaaaatgagagcacatggacacaggagggtaacaacacacactggggcctgtcggggagcatgggagggagaacatcagaataaatagctaatgcatgttgggcttaatacataggtgatgggtcgataggtgcagcaaaccaccatggcacatgtttacctatgtgacaaacctgcacatcttgcacatgtatcccggaacttaaaattttaaaaaaatttaaaaaaaaagaaaatctgaacttgggtagcaatatctctacctaatgatactcttgatttttaagtacttaaaatgagtctgaaactgtagaggaagaaaaattcttcctaccaccctcctcctttctctggctggggctttgtaaattggactgacaaagacagcttaacaagagagaagcaggagtttattagtgtgtgcattgggctcacacgtgggagcactcagacgtgagtaactccaagggctggtaagaccttgagctaatatagaatctcagcaaaggaacaataaatttttagagaaatgacaagacaaaggaacgaactttgagtttctagggtggcagactgtgggaaagcaaatatatgggaaacctattgtagataaagattagttagggaagtttatgtggatgcctgtggttccgtctctggactcctaagggtctagagttgtctctgatgattaacttttatccttcctagtagagaggggagggaaaacacctttgcaaatttgtgtcctgcttttaggcaaacaggggcagggcagagagcttttcttatagctgttttctctcaaaattctgtcttcacatcaaaataatcccaatgccaaagtggcgtattttggggtggcatattcggctaccctacaggacctatgcaaagatatatctttatatatatttaaaccatagttttcaacaaagttggaaacaagaataaggattgatttaaaagatattatatagccattgacatcatgctgcataaaacctatttaattctcatctaactggtagattatacaaataataacattgctttcctttggatattagcattggaaagagtgttttttgccagccttgatggtgcacccctgcagtcccagatacttgggaggctgaggtgggaggatcacttgatcccaggggttcgaggctgcagtgagctgtgattgcaccactgcattccatcctgggcaacaaagtgagacactgtcaatcaagaaagagaaaaagaaagagagagagagagagagaattctttttccttttctttcaaggaaaaatcagaaaatgagtggttgatcttagttcaattaaagaaaacaaaacaaacctgctgggtgcctcctctgctctaaatactaagcaagaaataaagtgaataagcccctgccagtcatgtaactaaactctgaatgagggaagtagctaaaatgttacacataaaagaaagctgaatgggaaaaatgcatggaaattatgagtttagggacattttcacttggccaaatgccccattctctttctctacttccaggtcattgtgataggtattttaaatgaacttgaataatcccttaggacagggttgcctgaggaaatgggggacacccagtcaaattggaatttcagataaacaacaaataatttttagcagaattgtgtcctatgcttacttatactaatatatatacatatattttatttgcctgaaattcatatttatctgcactatatctggaaacattaagaataaattgtaacatcttgtatttgtataaggcaacattttaccaatcttttcttcagaatactagttttatgaaactcagcaaaaagggctatgtggtcccaaaagttgagaaggcatttcgtgctatagctcctcttgcttacagctgttaacttggagtgataatcacctgttctgacaaccagcatagactggactccttctagctgttaacacctctgcagcaggactgagaaaggactggagagccacgtgctatggtttacacctctgagcatttgctgtgtgccagccatcacactacatgctttacatacttcatctcactaatcctcacacacttatgaggaaactactgagagtgtatgcatgaggaaatgcctcagagaggttcagcaacttgcccaaggtctcacagttgtaagggacagagtctgaatctattgcctctatacttaatcaataaagattcattatatgcattagctcatcaaaggttctaagatgtctagagtaaggaaaatttttgactttgtttaaataaccatttcctggaagcaccatcgaaaacattggtagttgcagggtgcagtggctcacacctgtaatcccagcaatttgggagaccaaggcaagaggataacttgagcccaggagttcaagccccatctggccaacatggtgaaaacccgtttctactaaaaatacaaaaactagccaggctggtggtgtgtgcctgtagtcccagctacttgggagtttgaggcaggagaattgcttgaacctgggaagcagaggttgcagtgagccgatatcatgccactgcactccagcctgggagacagagcaagactctgtctcaaaaaaaaaagaaaaataaaggtagggtgttttatatttatatctacataaatctatacattatctagatattatactatattatggaaatgtatatattatattagaattaatatttctaattatcgtatacagttatacattttattgtgttattataacatattatatataattggttctgtttttctgaagagccataaataatgcattcaatttagaagacaaactcttttagttggaatgagcctaataaaaataattaccatcccaagccaactttaggttattatttgtctctgacagtattaaattatcattatattaaattcctagaagcactatagaaatggcagcagagtatttatattatatataatataggttatattattagatattaatatattacattacaattgtattatcatgatattatatataaattggttctgtttctcttgacaaccttactaatacatccagtttagaacataaattctattagttggaatgagcctataaaaataattaccattccaaaccaactttaggttatcatttgtctttgatattattaaattattattattttaagttcctaggagcacaatagaaatgctggcagagtgtttatattaaatataatataaattatatttttagatgtaaatatattactttatgatgacattattgtgatatatatataatataatgagttctttttccctggagaaccttaactaatacatctagttcagaacataattctattagttagagccagcctaacaaaaataattaccttcccaaaccaactttagattatcatttgttttcaaggccatggttctcagccttagttgctcattaaaaatattcggggagggcaggcatgatggctcacacctgtaatccctgcactttgggagaccaaggcgggaggatctcttgagatcaggagttcaagaccagcctggccaacatggtgaaaccccgtctctactaaaaatataaaaattagccgggcgtggtggcacatgtctgtaatcccagctattttggaggctgaggcaggagaaccacttgaacctgggaggcagaggttgcagtaagccaagatcgagccactgaaaccccagcctgggtaagagagtgagaccctgtctcaaaaaaaaaaaaaaaaaaaaaaaaaaaaaaatacttggtgcacttatgaaagcctgcagagcccagaaattctgatttaattgatctaagaaaagggagaggtaaaagctcccaggaaagtctagtgcccagccaaaggccatgggagtgatgagtgaccctgcccacacctaacggagcgtcccctgctctgctagtcagtcaacagaacaccagccaatttctctaagccaagagctggttatttccaacctcccctggaagagtttacttaataccataagaagtcattttctcttccatctactgcaagaaaaaactggatattgcaattgccatcctttttgagttaaaatactctacatttttaaacaaataaataaaaaagcttaaccattttgaaattaccagtagggaagaaatcgggtgaaaaaggagaggaaccatgcattactgagaatactcctgtcccaaatctctctccatatccatttcttaaatttattcattcattttaaaaactcaacttacaattcttgaaatctttacctaggatatgtcagccagtattctagacatctggtatacatcatagaacaaaacagtcctgcccccatgaagtttcattctagcttacccctagtatatgccaggctctgaactaagtctaaaacagatgatccctgcccttccagctccctgcaaagccagcattaataataggagggctttttacagaaaatgaaactgtgacttgtttaagttacaacctgtgagtgttgaagtcagagtaccagtctttcctgtataccttaccacctatttgaaaaatgatggatagttatcttaaacggtgaagaattagtgtaagttcttaaacaaaatagtggcgatattaagatcatgcttgagaaacctaattcttgctgtctccttacatattttaagtttggcctaactctgtctctgtgcatagtgagctgtaatgtaactggatgtgtaaacagattgtagcctactcttgtgccaatctccaagttttggccaatcaaaggtggccaaccattcaaaccatgttcaagtaaggcaaacatcaagctgtaaccaacccaactatttttgtaccttgcttccattttccatatgtcacttttctttttctgttcataaattctctcctaccacgtggcatcacgggggtgctctgaacctcttctggttctggggctgatccattcatgactcattctttgctcaattaaagtctgataatttaatttgtctaaagttttccttttaacacgaccaagagtcacagattgcttagtctggagaagctactcttggctctatgcagtccacaaaaaatgacatttagaaatggttttccttccctggtctccagagaagcagcggctttcatactctgaaatgcagcatcctcatctgtaagatgcaggtgctaaatgatgactgttgttctttcaaatgttaactttctatgagtcacttcttcattgtatgtgtcaagaagcacaacctcgaaagcctgcctttgacaatgcttagaggttagaggatgccaaatgagcctcatcttctttggctactgagttagtaaccatccttcatttatctcagggagcaaaggcaggatttccgtgggtgtccaaggtccttactcacagtcaggatgcatggcagtacccttaataactacagattcagaatcacagaagacatttaccgagtatgtattttctgccaaaccctgtgccaggtgttattagaacattacttatgaaatatttggtagtgtggatgaagaggcagcttttcctgcttacacaatacagaaatatgatttcaaaaatctattaaaattttattaatctcagaaggcatgatttctaattgtgtttgatcttacacttgttatgatttaggaattcacatctgagttggttgcatgatgctatagttggcaacatgattctgaccgccaccatcacaaatagaggttagaaaatattacttatgtgaaaataaatgccatttctggcacctaaaacagctcttttctcaccttcctatgatgaggttttattgagcttttgcaggaaagaaaagaaagaaatctgcattcaggtttcaggagtaaagaggctgctcattaacaaagccgtttcaaaatctattgaaatgctccaccacgaatacatgccctattactaaaatcactgtcatttctatgcttttcttctcccttcaatcacataccacccagttttcagttcctataattgccaaaagccatttatgaatctgccttattgtatgggttacaaacgtctattttcctgctctgttcatacacatttgggagcaccttaagatgctgaaacactggcaaatgcttaatatatttcatttgaaagaattatgatctaaatcttaaagaaacagtgagtaaagtgcagtttctgctgcttggttactgtagttcattcggggaatttcatcttggtcgtgttgaatgcagtggttagatcctgtgaagttgtttaattaaaggtgttctagtagtcaaagccatgtctaaaaccccgtttgtttaattctttagtaatgtcaacattcctaaatttcatgtagcctaagagatttttccactggcttcaaatctgagctttgccactttggtgtcctttgctatgaatgttcaatgaggcgttctgagatcaccaagaatagaagagacacacccccggctgtcagaagtttaaccttggagaatgccatgaagggcaattctggaagaaaaaagagaagggaattcctcgtaggtttaagatcagaaagtggggaaggcgggggtgctcttaaatgcatcagccctactgccagcacagtggggactattaacacatcatattttttttttcctgcagttactcaaccttgcagtgggacaagttgctcaatgacttaccaggagacaattgttatttttaaaaatgtctttcttattttaactacaaggacttggcttgcttagaggctcttgctcaggagtctttaaatgcaaatgagggaaaccccaggttataaagcatctgcttctgcaggttttcaatcctgttaccttagcaacatttgcccttgtattccacgcatcaccttgacagcctgcataatataagggacggagcggagcaggggctcggggtgggagcctggaaagaaaactggggctcaaggaggtttaatatcggttagtagcttgggatccttcggataacggctgggcaatgaaaataaaaagccccatttccagaaatcaaagaacttggggagaaataaacacgctggttcaaaggaggggaaaatatatcagaactagtcggacctaagggagcagatattttccaaaaatatccttcccaccagccatgctgcagatgtgtcactgtggctcagaggcaggccatctgctgcagtgtttccctggaaacccccagcaacgcccctcccggagctcctccgcggtctcccccactccatccccgcgcagcggaggagcttgccggtgatgtcactgctgctagctgggagggaatcccaggacctgcgtccctcgggtagagccaatcatggtcggctctggatgctggaaacctggggcttttaaccagaaagaattgcaaaagcaatatgcaattcatcacagtccacaaagcacagttcctaacagattctgaaaacgtgattttaaaaaaaatgagatttatccgtaaacgagggctaggctacagttggtagggcggctgtcaattcttctacggagttttaacctacactcaatggatgcatgaaaaaaagaaatgaaatgatttttttagctactttaaaaaataaaggtaatgaatatttcttatctatatgcatatatatatatatttcattataattgttgcttctgcagaaaattgggatagaaatctcagatgagctgtagttacacggagatctacagcaatgcaatgtttagctagcatgcattttgtcatccaaggctagtaggtgaaatatttcctttacctgtcttgatgcacggtggagaaaggagacccgcttcgttttccctctaatctagagagttaacctcctccaggtagggttgaaaatatgaacagagctgcttttgcaagactgtgttgcctctaaatgtgatttaactcgcatattcagaatcttagcaaaaataaataaataaatagtaagatggggtaaggcaaatacatagatattttggagatcttatcccttattcaaggactgtagattattacagctttgttgtcatattatctctaggcagtaaatcatagtaaagtagtaaattcatagggaatgaattaatctcctttttgttttgttttctctgaaaaagagggtgtgattacagcatatattgattgggtactgattatgggacattttcattgtatttgttgttgttgcagtagactaaatgtcgagcccgtgaatctcttgtgttggcattgtcagaaaaaagttgtattttttttaaactggtctaaaaggaaaaaaattgaacatatatctttatattttttttgctctcttctcaaccatgtttagtgttttgtttatattcaaaggattttattttcacacttacaattctttacttgtctgtcattcaaatctttgttaccaaaacagtttgctctttttcatcattcactaagcattcctttcacagctaagctaaagtgtctatatggaaacatacatacacacacacacacacacacacacacacacatgcacacacactttttccaggccacagacaggaagatatgtgtaaatgtatacatgttttcagtagcatatatacacaagggtctccaataagatttttctagaaacaaaggctgatactacttcatttcatattattgtaaagtgctaattctaagtaaaagtagactaaaaaagagataaaaataaagataaaaatgagtgggctctcacaaccttgtttttttctttttgtttttcacttactctcttggctttttaactccttccttctctgcctcttatgaatgacaccaggaagagttattgtaaacaattggaatttctaaagttctgtgtaactgttagtatattcactatatgcatggtataatttataaaattaatctttgaaactgttaacccctagaaacagaaagaaagaaagaaaaaaagaaagaaacataaagaaatcttgacccactataaatcctgttttctctgccatctcccccagttacacccagggcaagtctatcttcttcaaagacattcagtcagcccacagctttttatcttttcaaacctttaatggcaccattagctacggaaccttgatttccttaatttttcccccactgtcactgcaaccatcacatgtggctctcagagcttctagttccctggaaacaggagttctatctgccatcaccaggtataaggtgccaccacttgaagggatctgccctatcaaaaatgaggaaatatattgatcaaaatggctggagaaagtgaccagccaaaacacagcttcacagtcttgcctgttttaagtagattctatttccattttgccggtgacagcactaagcaaataagcaatgttgccaatccgagaacagcctgcattcaaggtattcaatcaatcaaagagagacaatggcattctctcaaagatcagatgttttgtagtgcaactatgttgttctgtttttctttacttcaattatcagatagacaggaaaaaatacaacaaaatagcatgtagttgatttgccaaaaataaatagcaaagaaaaaacaagaataactagaaaacacgtgacaattttagaaaaaatgtaatcacatttccaattactagacaagatataaataaagagcatttataaaatgtttaaatccattcttttaaaacgataaacaacttctctaactggaaattactgtgcagctgctactttgtattttattggtataaaataactttagagttctatttcattgcattgcaaaggtgtaatactttgccataattaggtttaaatcttgcaaaaatagaaacctgcattttttggttttatattagtttttttaggtgatgctattcaatgggaggatataattgctgtttctatgaccttgggtaagtcatttaacccctctgaaccttggtttccttctttggttgaaaatagagacagtaatacttgacctctctctccagattttgatcaggttaaagaggccaataaaaatgaatgtgattttgtaaatagtgatacacacatctgatgcactgttgtgtatttttgcacctcctcagcagtgctctagctagtctgtccttgtccttgtcaactgtacgtgaacatgatgccctctagtgactgcactttgtagatgctgtaggccccaaggaagccttgagaggaaaaaagagcttaatgaagttagagaagggaagggaggcccgtagcggaaaattatgggttataaaccaataaaagcagcaggaaaaataagcagcagctgactatgagtaagaggacaagatgcacaaagagggagaagagaaaataagcagaatagagagagaggtgagatgtagctgattttggaagagttcactgtggcctggaaggagaggaacaggaatctctgcccagctttgtttataaccggcagtaggtccttccgttcatgtaagctctgccctccacaactcaccctgtgactgcaaaatgagatagttaaaattaaggttcagaattctttgagtcaatgtaagaagatgagcgaaaagtacaatgaaaatgagaactgaaggaggaagagtctgtggaagcaatttccagaatcttgtttactgtgtctaaggtcacctcagtattgcagtaacttaataacaaccaagcggctgaatgaggcaagctcaggtggggtttggtcgatcgcaggatgatcctgtactcttgtagtaacaggagtgttttgcagtacagctccacccttcacaaggatccagcccctgtgagattgcatcctcttagactgaatgcctaggagtctcactgactacctgtctgaagagctccttcttcttttctgaattaatccttctttacttagaactatctgaggatcaagtgatcttccagtgggaggatatttaaacccagcttccccttgcaaattacagatgctataatcctgtctgcattaggcttaggtcatgctttctctaaacgaactgtgtattacaggaaagtaatcaaagtccacaagaactgtgtaattaaaccagtgatggtgcaaataatccagaagtctgtcattgctctctctagacaaaggatcactcaaagatgagaatttgaactaattttactgaaagacaggatgatgcagctgaatggaaagaacactgcataggggtcagaaggtgtggattttcattctgacatggacatttgctatctgcctgatcttctgcaatattctaaacttaacaaagccttatctatacaatgggaattaatccatttattcatatatattaaagattttcaatgtgccaggcactgtgttaaacttccagatggcagtgagaaacaaactctagaatttctgagtcatgataaagatgaaacaggtgttatattttaaaactcgaaatgtcataacagtgtaaggtactatgcattcctaaagcaacataaaacaatagggatttttccaaccttaaagagcagcatttaaaattgagtcttgccttgggagcctgtgacccacgggagcattggaaatgacatcaaccacgaagtcttttttcttccagtgaaatgcaaaacctgctacctccctggagctattagcttggccaaatagtcctctagttagtaagtggacaaagtagttactgcacggctaactgcaactcttcatttaaatatttccctcatgtccagataggatatgtctaatatcatatgcctaatagcttttcagcatctttccacacagaaagaaagggaaataagccttgtcatagccatgaagtgtccccaccaccagagtttcttctctgctacccctatgctgcctaggaatgctaaaactattttatggggccaccaggtggcagttagggcaaatggttttagtttttttctttctacattcttggggaagaccaggggcttaggaatggagaagcaagccttggaaataaaagcattatggagcatttgggggtgccaggccctgtgctatatgtgatatatgcaatacctcacccaatccttatatcaatatctgttaaatatactattgaacaggtgaagatagagtaatatgggaaataaaacatcttccgtaataagcagctagaaagtaccacaatgtaaattcaactgcagaagacatgacaccacagggaaatttcgtttcactgcagcagtgtctaaaaactgaagatggggaaagtgtagagtgtgttattaaaatgattttttcaaaaggttttaagagtctaaataaattgcataattagtcagtttcctacctcctagtcttcctacctttagtctttatttttagctctcctgagtttgtagttgttctccttccatggtttgattctctccttagctttcagattctatacatttcacttctctttataaataatttttaaaaattcttcatgtgaacctgttcaagaacctgttgcattgaggactgaagatatggctctagattccttactgtttccggtagagaatctgcagagagaatatttcactgaagcaaaattataaatggaacatttgactttatatttccatgtccccaaagatttactaaacattagatctgatttggccaactttttctaccaatatttccggctcttgatatgaaactagttaaagctattttttcccttcaatcagcacattttcaaacttagaacatctattactcaaatttggcataaaattatgcagccagctcattatccactttctgcatattgccaagggctcgctacgtatgtgtgttctggttggcagacattttgggtaactactattctcaatttgtacctactttatttcaatacatgtttcaagatgagtgttaaagggtacattgctttaggaaacttgtctttttctggcatttgaacttgcctaaattagaaaaaaaaattctggttccagtcctttttttctaaaaaaatattccaaatcattagatgaaactgttaaagataacgtttggaaagtttgtctcctctttggtgattaaaaagtgctttccatttttggcccatggctcttttcctggggcatagcatttgattataaagcttttctgatgaaagtatcacaggacagcaaacatgagaatgggagaaataattttgcatgcaattttttgtcatctggctgcactgtatgggaaatacattttccctgtcaaaatgtcaagttgttttgacttcacaacaaaagaggaaggaagttcttaaatgtagaacaataactcagctcactgctgatttctatttgttctatccttacatcacagtatagagatagaatgtgtcctacaaatgtccatgcagcaactcatattcacttggcataattttgtttattgtttgagaaagtagtattttgggtaaaaattctgaaacaggcagtgagtatgtctgagtatttctggcaagggctatttcttcctttctccttttactctggagttttcttgaactgagctgtttggacaaatgacacatatttcaagaattccaactgtgggagtgtttcactcacaggattgtgctttcttctaagagccaggtctggtgaacactctcaggagctttgtaacatgttccaagctatgcagaagtgcttagttcattcactagtcaaagactaacacatttacagcaataaaatgcattataagcattctttcttcatgaatctattcatcccattaaaaaagcaggaattccaattaagtgaggtaaaatatgctaagtagtacagtataagatttttaaaaattacaccatgtttttcatggattattttaagaaaaaaactattttaagaaaaaactgtcctatttttggaaggtctagtcccaaactgcacaggaaagttagaggtaaactgttaaagtctttgagaactggcatttttcaagccgcagtgaatgaaatcaagcatttctctgtttctcctttcctttcggaatttcttttcctgaggcttgagaaggcaatactggtcttacttttcacatgagtcaagtttatactagctgagcaccctgaatcattaacgtctttctccccaggggagaccaagctcaaatccatcatcagaatacatacttagaccctctcccttctttctggccccctgcttcttaggaatgtgctctaaccaccacagcattcctgatcaccacctccagatgacaaaaagaaaaaatgagtggcagtgaaccagaagagcttaggccatctattttatcctaaaatctgttcagaaatacgaggtttgtatcaattagtaagcacactgggaatacaggtatacaagttgttagcaatatttggttatataatgtctatagatatttattttgctttctctcagatattaagaattatgtctttcctttaacctccatcatttgtttttctactttggtggaagctttttgtttgtttctttactgcaacagtgaatttatccttggatttctccattatgattggcagtatttatacaataatttcttggtattagttaattgataccttatatttactattttcccccaaagctgagtaaagaatagaatgaaatggcctatacttatcagtgtaaatggatattagaattgctgctcttattccaaaaaatatcacttaaagttcacaaatgaaagttaataactgaattttagtaacaacaacttcaacttaaaaaattccatgtaattaatagctcatgagtcccactgagataggttgaacttcataacttctaaagccttttatgtttctactacttttcagttctaatgttcaatagtagcgtgagtatctggttagtttcagtataaaaaagatgatacccacttgtgatatgattctactttcaatgtcacggtggaatcatttattagttttttaatttaatttttcacatgtgagtgtgatacagaacacctgatttttctacactataggatgtcagttcagtaaatcgattttcctcattagcaactgcttatcaatgactatgctgtatagaaagcaagagtattatactctatttttgatcacagataattgaagtaaatttaattagatccatatgaaagaaataagaactctcacaattgtgacatatatacgtgtctgtgcatatgtcatatcttagtatatgaggtatttgcatgtgcatacttaccaagttaaacgacctcctatcccacaaagttctctttagaaataaacttgagtctcttgtttgtgaaaccaaagagaatttcccgccaaagaaatacctacaaagaagtgtaggtaaagaattcaaatgattgactcaggcttaagatgatttgatagctctttctgcaccaagaaacacagaaaatctcaaagcaggcctgtgccaacttggtataaaaaaagccttcctaaagagtgcattatcttcaatgggaaacgtcgcagtacaccttggcatcaccaggtcaattagtgcaccggaaagatgcatgatatttcctgttggcagccacgaagtgagagaattggacggctactagccctgttgtgtgccaaggcctaaaaatcatgcaaggaggtgaaatgatgcgtgccaagaaaatagcaaccacaggaaacagcaaataatgtaaggttttgtgtctttactctagatgtaaatactcatttaccagggcagctttaaattgacagcttttgggtttgtgaggatattgtgagtcagggttctcctgattgggcaagatgaacgagtgaacaacatcactagggggccggagtagatgagatactcactcattcgtgtgcctgctttagcaccagcagtgtgggaatggggagaaggccaatggtctcaaggcagtttccagctctctggcaaacaagataaggccatggctgtaacagacaccctctgccaggttctaaaatctctctcttatgacctttttaagatctttaaagcaccgtctgcccttggccaacaaaagagaaaaaacagagtcaatgcggaaaacgctgccaagacaacattttcttcttaagatcctaaaagcaccattttccctttgctaacaagacaggagcaataaagagtcaattaggaatatgttgccaagacattggccatataatttctactccagtcggttttgggtttgatgcagtttagaattctctagacacattttttcatttttttttcttactagaacgcagaatgtttttgagagtagaggtggatggcactgctcattagaaatagctgtcctgccccagaacaatcttcaagacaaaggttgcaagactatctttgaccttcctgtccctaaacactccccaaccccaagccaaacacgcgcctaaaagttttcacaccttgccctttactaacagcaatcatatttaggaggaatatattattgttagtcaggaaattctacctggcttcaggaggtagcttagtgggtatttgctaagtctgatacctttcctttcaacatttagctgagattacctatactaagagcacgaactacaactgtggaaaacagaagaaaggagaatgttctccaaatcaaagtgtgctaaggtcagcttggggcagccaacaattcctggaaggtgacagagataaagttgcagagagggaaatggttgaagacaaatgtctcacgccttaaaatgttgctaaagtaagatggctgtttggatgagtcatcaacaagaacatcacctttgctctcttcctgccacccctgcacttctcaggctactgctcctaaaacctagaactcaggagtgatggaaatagagggcacccatggcaaggaagaaattggagagtaggaaactcagggaagttaatcctgaggaaagtggaaagtgactaaaacattttgagcagagaaaagtcaataaatcaaatatagaaacaagagatgataggaggttctcataacagtccaaatgagaggaccaaaaggcctggagtcacgtcattgcagtaaaatggaagaaaaaacaagagtataaatgaagtgtcaaagatgttaagaaacaggatcttttaaaaaattatttttaattattatgggtacataataagtgtatatatacatggggtacatgtgaaattttgatacatacaatgtataataatcttatcggggcaattggggtgtccatcacctcaggcatttatcatgtcttatattagaaacagtccaattctcctcttttagctatttgaaaatatacaataaattattgttgagtatcatcactctgttgtgctatcaaatactagatcttattctttctatctaactatgcttttgcacccattaaccatccccaccttctccccatgctggctatccttcctagcctctggaaaccatcattctattatctatctccatgaattcactaggagaaataggatttttgactaatgggtcagaagaagcaaaggaaaggaaaggaaaggaataaagaatgactcaggtttcttgcctaggaaattggttaaaaaaagggtatttttaattaaaaaaggagagttgaataggagactaatttgaaggagaaaatagcctatttttagatgtattaaatttatcaaatttgtgtgctgtatatcagggctcaatcacaattctggcataaatttatatattttatagaacattattaacttgaaagaaatgcatgtattttgttaattgatagaaacaagatcaaagggcatattatattattattccgctttgtaaggaaaaataggttttgcatatttatataaaaagggaaattgaatgtgatatactctggggtattaataataattgtgaattaaattcctttctttagtttatattgctgtctcaaatcttctgatttttctaccttgaatgtaaattttttgtttgtaatatggcactttaaattaaagttgtttttcagctgggcacagtggctcacacctgtaatcctagcactttgggagaccaaggtgggtggattacctgaggtcaggagttcaagaccagcctgaccaatatggtaaactccttctctactaaaaatacaagcaaattagctgagtgtggtggcatgcgcctgcagtctcagcaactcgggaggctgagacagaattgaattcgagaggcggaggctgcagtgagccgagatcataccactgccctccagcctgggcaacagatcaggactccatctcaaaaaaaaaaaaaaaattaaattaaagttatttttcttttcttccattacccagactggagtgcagtggcatgatcacagctcactgcagcctcaacctcccaggctcaagtaatcctcccacctcagctttccaagtaactaggactacagatgcacatcaccatgcctggttaatttttgtaatttttgtagagatgaggttttgccatgttgcccaagttggtctcaaactcctgacctcaagtgatcctcccacctcagcctcccaaagtgctgggattacaggtgtgagccactgcactaggccttaaaatttatttttcaaaaacttgatgattcaaatcattgaagatgctcttatgccaaagaaaaggtagttctaggaagttcatggaatcttacaaacacctttacagctcaacagaattgcaaagatgggtagtgttttgttttgttttgtttctctgattgttctacagcttatagatactgaggttacattttatgaaacaaaagtaagaatacatgatttaaaagtaagatcaattcctaaaaattggacctgaaaattttatggatagagtagatagacgtgtagaattcatcccagcatagagttgctgggatattactggtgcttcttcacagggaaagaaacctggctacccagactacaaagggaaagggggaaaatggcctataactcatatcaggtgaattagcaaacattctcatttcagacgatttttgctgtccctggtcatgaaatttccttaactgggttctatcttttactttttatcccaggcttttagcaagggtcataggaaaatggccatttccacatatctggtatatcccatttgaagatattgcctaacaaacattactcaggatcccttacataaaaacctccatgataaatttcttctgtacttttttccccaaaaagctggattctcctgtaaaactgttatctattctctttatatattataattatggaattcattatcatttctactcttatctacatgactaggtcaccaacagctaattatatagctaattcatggtagttaattttatttacttctcttaagtcatgacttacaaaattgcatttctatgtatgccatcttattacctccatttatttaagttgcatactacttcacatttcctttgaagtgtatattattattagtagtagtagtattttggagacagggtctcactctgttgcccatgctggagtgcagtggtgcaattatggctcactgcagcctcaaccttccaggctcaagctgttcacctacttcagcctccccagtagctgggactacaggtgtgtgccaccatgcttggctaattttttaaaaatttcctatttcttgtagagatagagtcttactatattgcctaggctggtcttgaactcctggacacaagcaatcctcccacctcctcctcccaaaatgttatagacgtgagctaccacacccagccatgagtgtacattataaataaataccaataatgtactttcacatatgaaaaggctataaaagtatgcaaatatattatggcaacatctgttaagggataaagtgacacactgttgctcataactcgaaagaatatatatatatatatatatatatatatttttttttttttttcttttgaaacggtgtctcactctgtcaccaggctggagtgcagtggtgcgatctcagatcactgcaacctccgcctcctgggttcaagtgattctcctgcctcagcctcctgagtagctgggactacaggcatgagccaacatgcccagctaattttcatatttttagtagagatagggtttcaccatgttggccaggttggcctcgatctcttgatctcgtgatccacccccccatcagcctcccaaagtgctgggattacaggtgtgagccattgcatccagcctcaaaagaatagtataaaccttatgtgttcatataagcagtagaacctatccctaatagttggattttattgtgtaagtgtttcattaaggaatgtctgaaacatgtccagatttttatttcagtggcttagttttgccacagaacttcagttttataaatgtgtgtactggcttaactgtgaaagtattaaaattattgtattgatttttgcttgcaaatgaaattcataaacagaattatcactgaaatttacatgcaagagaaattgatcaagatgatttgaaaacttatggaaagattgaaggttgccaaaatctttctctttctaacttcctacctttatgtacatttacactctaatcacaggtatttacaggccttaattttaacgaaaatgaagaaaaccaagaaagaaacagctctttagagcaatggaaaatcttctatgatttctcactgacattggctagatactctgcatttatgagcaatcatgcatgtatatcatcagatttaaccttcacaacaattccatatatattatcagatttaatcctcataatagtttgctatcctaggttttagtttagaaaactgagcctcccataagctaagaagttacttgtccaatatcacaactttagataatggtagacttagattaaatccatatttgctcgctctacattccatattcttcccatttaattgaacaagattttggaataaagttgaaatccacaaaaggaataggacagtgacttcacaataaaaatattaaatgtggcagaaagtatggatgtcaatggaatgtaaattctgggcctcctcaaaaacttgatatactcatcctgtgttagttgtgaaataaacaggttggagagtgaggaaatgtggtttttgttcccagagtcattactgaccaactgtgtgctttgatattatatttgctttctgatactaattatattaattctcgctcatagaaatcttccctccttcataccccacctctgtttgattcttaatctcatacataagaggtttttattcaatgtctcatttttctttccaggacaagtatgttgtaagaattaattaatagtcttagaaccattcaagcagtaggttctaattgagtatttttctccccggttagcacagcaccctgtcagagccctcaaagtcagacaaagaaggatgaaacatgttttggtccttaataaagaactgctgattgactgtttgaaaaacaaatgccgcacacctgtaatcccagtgctttgggaggccaaggcaggaggattgcttgagcctaggagtttgagaccagcctgggcaatatgatgaaacctaatctctacaaaaaaaaaaaaaaaaaaaaaaaaaaaagagccgggcatgaacctgtagtttcagctacttgggagactgaggtgggaggatcgcttgaaccctagaggcagagttacattgagctgagattatgccattgcactctaccctagggtgcaagattctgtctccaaaaaatgaaaaacagctgtatggtttggagagccagtggctgacaaactgaaggtcatggctaacagagtctccatatcagtgaatctcaaacatctgtttacataaatagcatcttcttataaaaaaatacaaattctgagcccccatcccattatagttggtaagtctaggatgagaccagaaggggtcattttaatgagattttcagatgactttgaatttatatttaatatttattctggtttgcctggggttgaagggttccccagggcatgagactttcagtcttaggcaaactggaatagttggtcactcagatttcggtgcagtggttaaagttaacactttcaaaaatattgtagtgatctagatttggttctaggagtttggctcaattcagggctaacaaaaaaatctgtttagggccacttggggattagtgattctcaaaaggtagtccttgaatcacttactgaatacctatagttgaagaacagataactgcattttaacaagattcaaaggcaaattaatgtttgatgaccgttgacatcaagtctcagaatcagaactgttcaacttccaagcaaatgaaattactaaactcacttctctgagtgaggctgagagcaagaagttaagtataatgttttttgagctaaaatacagagtctactatcagaatcctgtttcccaccataaggattaagatttttttgtttttgtgtgtgtatgtgtgtgtgtgtgtgtgaatgtgtgtgtgtgtgtttgttttttgtttttctgaagtgaatgacatcgttttttggaatgaaaaggtcttgccccaccctgcaagtgtatctctgcctttgagacaatttagccctggaatcaaacctgggggggaaaatcaaattatgatattaaagaaaacgctgacaaatttctaaattcctttcctctactccctgctgcatacaacttccttctttctatctataaatactatatctgctctagaaacgtgaaaaataacataaatattgaacagagtgtgaaggaatttaaactttattgatgagtagtagtattacccttctggactgatgcagatgagagcaccataaagacaaagtgagttcttttggtccttaagccatgaattggagtctggatagtagggatggaaatgggttattagatcatcagttcactttcctctccaagcagcaattaaatttgttttctttgtctcagcttactcgttgctcaaaaaaaagaaacatttcagctcctcttcatggggaataagaccaaacatagaacacttttctcttaacatgtgtggtgcttgagaggagaaagaggcaggaaggaaatgcaggagaaatgtgggaatcacagttaacctgaaggattactttggctgtccccttcagctaatgtgaacattctggcagtcagatgcagccctgtgagaaacatctatcagacatcctaagtagatgctccaactgctgtttttcatgtacagctgactccaagatgagtgtgatgctatcacggtgcaggataacagagatgtaccgcgaacccaacactcaagatgggaatgataaaacttcaataacaaaaacaaaaaaacaaaacaagccacactatcctttcagccttcagggatcgcctccttaaactgttttctaaaatctttctgcactttatatcaggtgcaggagaagtagactacatacattatttgttgtctatctttgaaaggatttcattccctctactgcacttaatcattcccttatctgaatattaactcagtgtaaagcttcccaaattttccaagttcttgaaagagagcaaaacatattgcaaagctctatatgtttcctgctagatatatttcgtgaaagacttcattatgtccactttcttttgagtttttgtgttagccctgcattgctataatttccaacatcccctggaacataatgaaaaccagagaattgctttttttttctgggtccattttattacattcttttacatctcttacttaactacttctaatgcctttgctctgaaactttgtgcatttgagggtttttttttccccgtgatttggtggactgcaagggcacacaaaactagcttatttttcctagtcaggcagttttgaatagaaggtgattgtgttttccagagataagtatgtaagtcttttctgctaccggaggaggattctattttagtagtctattaagtagacaataagcgctgagttatgagttgataagtggatctgcttaccacctagaaacatcaattgaaaccacagcttatggtttcttactgcctctttttggtttctcactgagtctttctggttattgttatcatttcgtttttgacttgggcttggactgttcagcttggctgtgttaatttttcagaatcaatgacttttatagttacttccatgagtttttcctcctgcattttatttaagcaattcactaactatttataagaccatctttgaaagcctgagatacatatctaggcaaatatccatggaaaaaataaacactctgcaaatttgcaaacaaatacagcaattgccaaagtagggttatcttttgcaatcagtactgtggtttcagtttgaaaaaataaagctttcttgtcagttttgctccaagggctatctgattcggtgtgtagtcggtgaggaaataaatacaggtataataatctgtgcttgctcaaaaattaaaaaatcctttaggagggggccaggcgtggtggctcatgcctgtaatcccagcaatttgggaagcagaggcagacagtttacctgaggtcaggagttcttgagaccagcctggccaaaatggtgaaaccctgtctctactaaaaatcttagctgggcttggtgacatgcacctatagtcccagctacttgggaggctggggcaggagaatcgcttgaacatggcggagattgcagtgagccaagattgtccagcctggacaatagagactctttctcaaaaagaaaaaaaaaaaaaaacctttaggaaggataaaactcatttcctctatcagcatagtgtcaccatattacagaagtatcaaggtcaagtattaagactactgaggctcaggtgtccttggctgaagggagagagaggataccattcttgcatagtcttcagggcagcagtaatcagcaaactgataggttgcttctgggtctaaacccactgtaatcatttgcttgtagagatgacaaagttatcagttgtacttacatccactttttttgttgtttcagaagcttaccacacttctcccagtttccttttaattagtttgtaattttaaatcattacattaagataagaggtttttattaaatttggtagaactcatggtaggtcctacagaaatcactgaacttggcagccaaaaacagtgaccaggctgaggatgtgcctgaattgaacagggagatgctatttacttcttaacagagacatacttttcacgcagaaacttggcaactggaggagaaaaacacagaggtgaaggggaaagaagactattctggaaattaacaggtttcaattttggttgttcttcaacttgttagctatgtggccagaaataagcctcttaaactctctattccttggtttcttcacccactactctaaatctgatgaaacagagcagtaagaatttcttaggatatagcttaatttatttttttttaaaaagctcaatctaaaaacaagcttaatttaaaacagagacaaacaaatatgcctaactttgagttttgacaaaaaatgcaaaagtaattcaatggaggaaagatgagctttaaaaaaaaaaaagtgatactggagcaattggatatccaaaggcaaaaaaaaaaagtgcctaaattcatttctcacatcttatacagaaattaactcaaaattgattacagacttaaacataaaatgttaagcaataaaactttaggaaacaaacaggagaaaatgatgaggacctaaagctaggtgaagaacttctagacttgatactaaaagtatgattttcattttaaatgaattttaaaatgaatttcaatgaattttaaaattcattttaatcaactgggacctcatcaaaattaaaacttttgttctgtaagagaccctgtgtaaagaattaaaagaaacactacagagcaggagaaaacatttgccaaccacatattcaagaaagattttgtacctagagagtataaagaactctcaaaactccacagtaaaatccaaacgatccaattaggaaaatgggcaagaaacataaacagaaattttaccaaagatgatatacagatggaaaataagcacatgaaaagatgttcaatatcattagccattaggaatatgcaaattaaaacaatgagatagcactatctacctatcaggatggctaaagtaaaaaagagtaataataccaattgctggagaggatgtggagaaactggatcactcatacattgttgatggaaatgtaaaatggtacactctgtaaacaatttgcttgcttcttataaaactaaacatgtatttaccatatgattcagcagttgtgctcttggacatttatcccagagaagtaaaaacttagactcagtaaaaacctgtacatgaatattaatagctgttttatttgtaaaagccccaaactggaaacaacccaaatatccttagatcagtgactggttaaacaaactgtagcacagctatactatgacatactatgaagcaataaaaaaggaatgagctattgatacagacaaaaccatggatgaatttcaagggaattgtgctaactaaaaataagccaatcacaaaagatttcatgtgatgtgattttatttatataatattcttgaaatgacaaaaatatagaaatggagaacagattagtagtttccaggggtcagagagtagaggagggagggaggtgtgtgtgtccataaaaacgttgcgccagggatcctggtgaggaagctattctgtatcctcattgctggtgttcacgtgaatctacatatgtgataacatttgatggaaccaaatacacacacaaacacacacatacacatatgagtgcatataagaccagagaaacttattttggtggattccgtaaatgtcaaatctttggttatgatattgaagtgtagtttggcaagatgttactattggggaaaatagtaacattgtactattgtcctgtgaattattgattcacaggaaattgtaaaaaaaaatgctttgtcctatacatttttttagaatttcctgtcaatccataattatttcaagataaaaaaagttttgtaaaggaagaattttagagactctttcagattttttattttgagatttaatcaattatatgagaaaaataagctttaactgaccactctttccttcctatccaaagcttagtcaatgagaaaatgttgcaagagaaggagaatggggggtacctgagactccaggagagtacataccctttttaaaaaagcaatacaagccagcagaaaaaggaaagatgggactctggagcgattatgtgaatctgtggttctcaaagttcagcatgcatcagattcccagagggcttgtttaaacaaaaatttctgccctgcaaccacagagtttctgattcactaggtctgggggtggtgggtgtggttcaagaatctgcatttctagaaagttcccatgtgatgttgactccagtgctgatgctgctggtcagaccacactctggaaactactgccatagaacatctgagagtcacaatttgaaactgtctcaagaaatttctaagtaaaatgcaatgcaataaattacttaagaattctctatatttacaactctttatttgtatagtttccttccccctcagtatgttggctggtaagaatgttctttttgattattcatctgtgtgggctcaagagtgtgtcactgagttaatttacaaagcctcggattgcatatccatcacatttgtagaaagtattatcccagaaaaatccatcaacacaacacataagctccaaaatgtactgcacaattggcgtgcaatagagtagtcaaagaaccaatgaaatgcaaaaagttatctatatggagatctcaaaatgaattaacaaattaaatcctttgacattgtatgagatcccattagggttcattgttacagttttctttaatgtttctaaaatagaaatgttgtcctgggcagagcagtgtaatgtacttgctttggcatcaaatgccacattttttttttttttgagacggcgtcttgctctgtcacctaggctggagtgagtgtgcagtggtgcaatcgtagctcactgtagcctcgaactcctgggcttaagcaatcctcccacctcagcctcctgagtagctgggactacaggtcccaggtgcccagctatttttaaaattttttgtagagacaagtcttgctatgttgcccaggctgatcttaaactcctagcctcaagaaatccttcagacttgtcctcctagagtgttgggattacaggtgtgagcctccacaccaggcattgtttctattttaactttgctacttacgagaagtcttaatttgaccaacaactaatgtaagctctagtttccccatatgtaaaaagaagataatgcctaaattgcagggtttattgggagaattaataagaacacgcctaggccaggcacaatggctcatgcctgtaatcccagcactttgggaggccaaggcagctggatcatgaggtcaggagttcgagaccaccctgaccaacgtggtgaaaccctgtctctactaaaaatacaaaaattaggggagtgtggtggtgggcgcctataatcccagctactcaggaggcttaggcaggagaatcacttgaacccgggaggcggaggttgcagtgagccgagatcgtgcaattgcactccagacttggcaacagagcaagactccatctcaaaaagaaaaaagaaaaagaaaaataagaacacgtctaaaataattagtgcagtgtctgacacttaagttctcaaatagtggcggtgaagatgtgaaggagggtagagatgactgtgattattaatcatcttatttgttgatcatattaaaatgacaaaaaccacaattattttgcaccaacctaatatttcagcagatgtcctctgaatcagaagtaaatagccatgataatcttaccattagttattttattgagcaattacaagtcccaggctcttacgtttttatattaattttttacaaccagtttatgcgatgcatactgtcctcatttatcatataaggaaactaaaacttaaagagtttaatatattgctcaaggttatccagtgtattggtttgctagggctctgtaacaaagtaccacaaaccaggtggctcaaacaacagaaatgcattgtttcacagttctggcgtcaaaaagtccaaaatcacagtgttggcagctttggttccttctgagggctgcaagggaaagattgttctgggtccttctccttggcttgtagatgtctgtcttctccctgtgtctctccatgtcattttttcctctatgcatgtctgtctctgtgtccaaatttttccattttaaaaggacattagtcattgctgggcacaatggctcacacctgcaatcccagcactttgggaggctgagagaggcagatcacttgaggccaggagttcgagacgagcctggccaacatggtgaaacgtgtctctgcaaaataatacaaaaattagctaggtatggtggtgcatgcctatagttccagctatttctactcaggaggctgaggcatgagaattgcttgaacccaggaggcagacgttgcagtgagctgagatcatgccactgcactccaacctgggtgacagagtaagactctgtctcaaaagaaaaaaaaaaaaaaagggcattagtcattggattagggcccaccctatggaactcattttaacttgatgagctctgtaaagaccctatctctaaattatatcacattctgaggtgctgggaggtaacactccaacttatctttattgaggggggcagaattcaaatccatagcacatagtagtaagatgtcatgctgaggtatgaaccagacttcatacgcaatgctgtggactaaacttttgtatgcctgtgaaattcatatcttgaaggcctaatctctactgtgacggtgtttgagatggggcgtctgtgaggctttaataggtttagatgaggtcaggagagtgaagtgcttgtgttggaattagcacccttataagaagaaaaaaaggccaaagcctcctctctctctgccacctgaaaatgcaacagggaatggccatccacatgccaagaaatgggcccttatcatacaccaagtcttcctgcacattgatcctcgatttctcaggttttggaactgcaggaaatcgacgttcattgtttaagccacgcagtctatggtattttgttatagctgcctgagctgactaagacaggcaatatatgacatggccgtttgctccaggacttttaggaaatgtggatcccattggtagtgctcagcaatcaaatttatttgatcctcatgttcagcagacatgttgtttttttcttcatgtattgccaactcttttatatgatacataaaacatattgaaaaacgtagacttgctatctttatattccacatgttggcagattctttccaagaaaagtgattttcagatcattccttaggagcgttgaggctgagaagtggtctttgcatatttatatttagaaattatcgagtccaaaatctaaatattgagtcttggtagaagagaaaaccagtcacaatttatgtaaaatagttgttcctaggtaatgaaccaaagcagggactatatttgagaagtagaatggtattgtcaaagtcagtgtacaatcaggaaattaaagagattattttatccaaactattgcagttaatgaggaatgtctcaaaagaaagggaagcagggttttatagatataggggaacaaaaagtttaagggatttcttaaccaccacttttttctagaagcatagggattaggtcacattcaacattttcagtccccacttctacttcagatcaataaacattataggatgctgaacaacatagaggtgatcatcagaaacctgagtaagactgagcagggtctaagaaatagtctctcaagagttcttgttggcattattgtcgtaacatcacctaaaccagctgttgagaagtagtggcaaaggccagttgtttcaaagtcatagagatcaggctccttaaaagagaagtatttaaaatgaaaaacattaatatcaaagattatgttaaagaccagagtttaaccctgagcataccagtccagcaaattccaaaaggtgggtggggaaaatctttcagttacacagtaccgttcgttgagtttcttgaagctaggatgtcaatgttcttgatgatgttcagtctcggttagctttcctctaagagaatgaaggacctgagcttttcaccagaatttgttaggggctcagacagtggtttgtgcagggaaaagtctggcctgcgtgtaatctgctgcagtggtgagttcttcaaagtttgaatcaagtagttggacttcagctggcagaatttcttcaactcctggagaaaagagctagctgctagacaacctagagttccaacaggaatctgggcaatcagatgttatttttcagtgacatcaagttagggaaagagagaaaaattggaaacattaatttgtagggttgtagccagatattgaagcaaactggaaggcttcacagtttggtacaaattaacaatttgggcaagataacaggatccagttcaatttttaggaaggtgtccaaactgctttttccacaaaggaggggaagtcatttaaatcattccagacaagtcagaatttgcatatgtatcagttacctgcaatttatgaaactgtataatatggctaagagataattatgtctacaatctgataaacaggaaggagctgcttgctatagttttccactgaaacaaaacatttctctctatagtcacccctcttttgatcaaaaataatctcaaagaaagattattcttgatcacaaaataaagctagtaccatcagatttggcctgattatttacattgttgtcttaaagatgataattcactacatagggtttcttatatttgctttgctgaaagttttcataaggaatctcaaattgaatttttaaaaaccacttgaggctaggaagctatatcaagaactcaccaacagatttacctacagtatctataaatttcagtaaatgcctctcttttagaggtcccaaaaatatctcaagttttctgagcctgcgaggaagtatcctttacctgtaaatttgggcacctcattagccaggaatcaggctgattttcccaagagggctttaaatgagcatacctaatgtttccaatatttcatgcaaacaaggaagagttttattgaacctatgcaaataactataattttgaaatataatgagaatactcagtaagaatttctgatttctctaacagtcaggcaggaagaaaaagataccaatgacaaatgtttcatttatatttgcaaagcatagacttctgaattgttatgagtttcagttagtttaagagaaaatagaaagaagtttcctatgtccaaaaaatcaaccattaaaatatcagcaatattccaaacaaaagctacagtcattcctcatcagttccttcagtcctgtgtaattcttgctctgcttcctcttggcttaacagtttcatgcatacatctgcctctccaaacagggctctggaaatcctgactcagtctgctggtatggtctcaaggttgtgtaagtgacggcatcagaagcttctgccccaaatgaaaagtacctggcatagagctttgccatggggctctgagataatcctttgttaagacaaagcactacagctagatttgtaagagctttcagggaagcaccacaaagcaaaattctatttgtaaatgacaaaagccttaaaaattactttgaaaaatcattttcaaacgtgaaagatgtaaggagtgtttatcacaagaatctccatttgaaaaatactggcttataggcacagaaaaacaaagatagtatgttctcacttacatgaggaatcttaaaataatcacactcgaagcagatagaatggcggttacaggggatgggggtggagggaatggggaggtgatggtcaaaggctataaaatctttattaggaggaatctgtttttgttttttgagttctagtgtacagtgtggtaagtgtagttaataataaagtgttgtacatttcaaaattgggaagagtaaatttcaaatgttctcacacaacaaaatgactagtatttgaagtgatgtcgttaactggctcaatttaattattccacatggtaggcataaatcatattatcactttgtaccccatatacttacaatatcataaattgtcaatttacagtttttttttaaaaaaaaggaaagcactggcttagaagaagctaatttgaaattaacgaataaaagttgttaccaagttaacattttaaaaataactgaaacttatgactcatgtggtgctctctaataacagggcaaagtgacatcgggactcaaagaaaaacacgttatggacataaaagcctttgatgactctctaggaattttccatacagcatacaatttctgaaatatttatactgataacattctgcccatacagatttgtcctagggaaggttaagcatctcttctgagttggcaatgactcccgtgcaatttgtaaatagtaacatatcaaataaacctaattcttttcagcaactttcttttcataaggtgaaataacaaatcctttgtgattttcaaaggccctctgggagatatcaaagacagtttcagatgcaatagatatcacttaggaatcagttttgggagggaaaatatcaaaagttgtcaggagattgggacactttactaggatacggtcgtgagttactgataaacaatactttgctaccttaactaaggtgacagcaaaaagagtgaaaaagtaagcacaggcagtaacatgattgtaaagaatcttagctttttcaaaagggagaagactttattaaataagcaaggacgtgataaactcaatacacaatataggaagttattttaagacatggaatctttgccttctaggcagattactcagaaggtaaagaaaaaatattattaagagtagactaagaagtcaagaaaatgttatgtttttaaacagaggcaaaattaaattctactttgcatcattatggcatttgatattaaagatctttttgaaatcttataaatgaattcatcaagccttagctagcactgaccacagcaaagtttgtttcccacaagcgttttacaactttctacgtctattcagcttttgtcctacacattaacaactagctatatgacttcagaataaaatgactctatttttttcttaacaaaaacatgttctgcaaaccttgcatacaaaattgtatctctctgctattattatgccttgtagaatctcattcatgtatattgattataatttttaaatagaaatagtaacatctgttgcacaaagaaaaaagggaaatggataattgtgatctttctgtcatacataagctttttgtaacacactagtggaactcatgaatacacatctcacaacttttaatagccatgcatattatttacagcacgacttatgcaaagtggcaaaaatgaacacatttattaacaaaactgaatgtacatgcttctctatagcatatagaaacaaaaggcaaaaaagtatataaacttaaaattatgcttggttaccaatatttcacttttctctcttgcatagaaattacataaatatccaattaatattcattaattaattcaatttagcttcaatccaaggttttaaattaccaaatatcttggaatttgtcttcaggctgacatgctccaaaatattagtaccattgaaagtttgttagaataatgactcaatttgcttaaacacaaatttttattttctattgtattaaacattaagtagaagtaatgctaggttatttggttggtaaatctaagtttaggaagaacattcacaagtagaatagaagcatacttgtgttatatttaacactaaaaactcagagaaaacagctatttttactaaatcaacctcattaattgattatcaaaataataattattgttaaatattgtttgccaaacatttacctagattttgtgaacttgaattattgtctctgagttatgttcctacaagagacagctttttcccctacagtaaaagtgtttaaggctcaatttcctcaacttctgggaatttgggaaatatttggtttatataaatggttatttatttctaagccaattagaatagagctcctttaagagattctataacctaatttagcgacaccatcctgaggtagggaaatattttatttttatttttttcagagatgggctagattagaactcctgccttcagcctcctgagtagctaaggttgcaacttccatagtagctgaaattgtaggtgcatgccaccgtatctggccaacagggaaatattacatactctaacaatgagtggtgacttcctttctgaattacagacatgtagacattaaagcagagatagcaagaatttagtttccattctaacatttaagccatgggtcaagagtggacacagaatcacaaaacttactgtttcatatcaaagagctgttctgttctcatgattcttaagtgatttgagctcaaaacagacaaacagaaaagcgtagcaaaccaaattctctgttgtctttcacccataagatacaagatctctaaaagtcattaatcccctctcagagatcaccaagtggtcagaccacaaaaccaaagccagtgccagaaatcaagtgagtactaaaaccttgccttgctaccaatagacaagggtccatatcacaggaccaggagttagacttattcatagttccttggaccaggaatggagcacaaagggcccaaataagccttattacctgtgttgagtaaacaaagatcccagtgcaggagatccatatcatggcaccaaactatcaaatacaggatgcactaggtcattaaagagaagattttattcaaagcattgcaaaatggagaacattgatttatggtgaatatcttgaagaaaaggaagggggtctggggttctataggggcaagaaaaaacgggagtcatccagaagtcttataaaagtcatgaagaagggtggagatgggtcttatctcagaatatgggaaggcagtttgggcctttgcattagttgtttgccagacactaaagggtagagaggtttcttaatcattactcttttccggaagcacagggctcaggtaagattgaatatttttcatgcctttcatcctctctgtctgatctctttcaaactgtcttttttgttgaggctatatgaaatgtttactgttttaccttccaatcaactccataaaaacggttgatataaagcatctagccaagttccactacattttagtcattcattatggaacatcatcccaaggaaggctttattctctctgtctaagcaagcaatgaagggagatcttttggaaatggcctagtatttgatgagaagcaagaacaaggtctacattagtggatcacagactttttgccactgagatccaccatcgaaaatgcattcattattacctctgcatgtgtttatttaactgcaacaatagtttaatgattttcataacacaaaacttcacagtgtatgatgacactgataccttctagtctattcccagctgttctatttcatttttttatagcttatagtgactcattaaaatggatttccacgaatgcaatgcaacacacagtttgaagtccactggaaaatcttttaaaactgttattataaaatgaatttagtaaccttttcaaaattttactagtgtagtttctgtggtttttaagaatacaaatattttgccttctggtcttttttttcacacaagtatatggcagattcctataaatattttaatagatcagcagtttccaatgccatgtttcggtgatgatattttaccagagatagtctgtaatgaaaaattgagacaaatgatgacaatgtaatttgcagacatgtatacttatttataataaatttgtagacatgtatatttagttagttattcaacaaatattcagtgccttttatatcttaagaatggttcatgttaattggaggcaaacaagaaaggcaaagttactgcttagttgaaatttacattctagtataaaaattgccatatttattattattattattattatacttaaagttctgggatacatgtgcagaatgtgcaggtttgttacataggcatacgcttgccatggtggtttgttgcacccatcaacccatcatctacattaggtatttctcctaatgctatccctccccgctccccccaccccacaacaggccctggtgtgtgatgttcccctccctgtgtccatgtgttctcactgttcaactcccacttatgagtaagaatatgcagtgtttgtttttctgttcctgtgttagtttgctgagaataatagctttcagcttcatccatgtccctgcaaaggacacaaactcaaccttttttatggttgcgtagtattttgtggtgtatatgtggcacattttctttatccattctatcattgatgggcatttgggttggatccaagtctttgctattgtgaatagtgctacaataaacatatgtgtgcatgtgtctttataatagagtgacttataatcctttgggtgtatacccagtaatgggattgctgggtcaaatggtatttctggttctagattcttgaggaatcgccgcactgtcttccacaatggttgaactaatttacactcccaacagtgtaaaagtgttcctatttctccacatcttctctagcatcttgtttcctgatgttttaatgatcgccattcaaaccggcgtgagatggtatctcattgtggttttgagttgcatttctctaatgaccagtgatgatgagttgcgtttctctaatgaccagtgatgatgattttctcatatgtttgttagccgcataatggtcatttctctaatgttagctgcataatgtcatttctctaatgaccagtgatgatgagttgcatttctctaatgaccagtgatgacgattttttcatatgtttgttagccacataaatgtcttcttttgtgaagtatctgctcatgtcctttgcccattttttgatgggattgtttttttcttgtaaatttgtttaggttccttgtagatcctggatattagccctttgtcagatggatagattgcaaaatttttctctcattctgtaggttgcctgttcactctgataatagtttcttttgctgtgcaaaagctctttagtttaattagatcctgttcatcaattttggattttgttgccattgcttttggtgttttaatcatgaagtttttgcccatgcctatgtcctgaatgatactgcgtcagttttcttccagagttttatggttttaggtcttatgtgtaagtctttaatccatcttgagttaatttttgtataaggtgtaaggaagaggtccagtttcagttttttgcatatggctagccagttttcccaacaccatttattaaatagggaatcttttccccattgtttgtttttgtcaggtttgtaaaaaatcagatagttgtagatgtgtggcattatttctgaggcctctgttctgttccattggtctatatatctgttttggtaccagtaccatgctgtttgggttactgtagccttgtagtatagtttgaagtcaggtagcttgttgcctccagctttgttctttttgcctaggattgtcttggctatacaggctctcttttggttccatatgaaatttaaagtagttttatctaattctgtgaagaaagtcaatagtagcttgatggggatagcattgaatctataaattactttgggcagtatggccattttcatgatattgattcttcctatccatgagcatggaatgtttttccatttgtttgtatcctctcttatttccttgagcagtggtttgtagttctccttgaagacgtccttcacatcccttgtaagttgtattcctagggattttattctctttgtagccattgtgaatgggagttcactcatgatttggctctctgtttttctattattgatgtataggaatgcttgtggtttttaaacattgtttttgtattctgaaactttgctgaaattgcttatcattttaaggagattttgggctgagaagatggggttttctaaatgtacaatcatgtcatctacaaacagagacaatttgacttcctcttttccaatttgaatatactttatttctttctcttgcctgattgccctggccagaacttccaatacaatgttgaataggagtggtgacagagggcatccttgtcttgtgccagttttcaaatgcttcctgtttttgcctattcagtatgatattgcctggggggttgccataaatgactcttattatttttggatacattccatcaataggtagtttattgagagcttttagcatgaagtagcattgaattttatggaaggccttttctgcatctattgagacaatcatgttgtttttgtcattggttctgcttatgtgatggattacgtttattggtttgtgtatgttgaaccagccttgcatcccagggatgaggctgacttgatcgtggtggataagctttttgatgtgctgctggattcagtttgccagtattttattcaggatttttgcatcaatgttcatcagggttattagcctggcattttctttttttgttttgcctctgccaggttttgctatcaggatgatgctggcatcataaaatgagttagggagaagtacctctttttctgtcatttggaatggtttcagaaggaatggtaccagctcctctttgtacctctggtagaaatcggctgtgaatctgtctggtcttgggcttttcgattggtaggctattaattactgcctcaatttcagaacttgttattggtctattcagggatttgacttcttcctggtttagtcttgggagggtgtatgtgtctaggagtttatcaatttcttctagattttctagtttatttgcgtagaggtgtttatagtattctctgatggtagtttgtatttctgtgggatcagtggtgatatccccttcatcatttttttattgtgtctatttgattcttctctcttttcttctttattagtctggctagtggtctatctattttttaatcttttcaaaaaaccagctcttggattcattgattttttaaagggtttttcatgtctctatctccttccgttctgctctgttcttagttatttcttgccttctgctagcttttgaatttgtttgctcttgcttctctagttcttttaactgtgatgttagggtgtctttcccactttctcctgtgggcatttagtgctataaatttccgtctacacactgctttagctgtgtcccagatattctggtacgctgtgtctttgttctcattggtttcaaagaacttatttatttctgccttcatttcattatttacccagtagtcattcaggagcaggttgttcaggttccatgtagttgtgtggctttgagtgagtttcttcatcctgagttctaatttgattgcactgtggtcaaagagactgttatgatttccattcctttgtgtttgctgaggagtgtttcacttccaattatgtggtcagttttagaataagtgagatgtggtgctgagaagaatgtaaattctgttgatttggggtgtagagttctgtagatgtccattaagtctgcttagtccagagctgagttcaatggaatatccttgttaattttctgtcttgttgatctgtctaatgttgacagtcaggtattaaagtccccactattattgtgtgggagtctaagtctctttgtaggtctctaagaacttgctttatgaatctgggtgctcctcatattgggaatctggttgctccttgtatttggatgtgtatatatttaggatagttaactcttcttgttgcattgatctctttaccattacataatgcccttctttgtctttatctttattgatttgaagtctgttttatcagagactaggattgcaacctctgctttttcttgctttccatatcttggtaaatattcctccatccctttattttgagcctgtgtgtgtctttgcacgtgagacgtgtctcctgaatacagcacaccaatgggtcttgactctttctccaatctgccagtctgtgtctttaattggggcatttagcccatttacatttaaggttaatattgttatatgtgaatttgatcctgtcattatgatgctagctggttattttgcctgttagttgatgcagtttcttcatagtgtcaatggtccttacaatttggtatgtttttgtggtggctgttaccagtttttcctttccatatttagtgcttccttcaggagctcttgtaaggcagacctggtggtggcaaaacctctcagcatttgtttgtctgtaaaggattctatttctccttcacttatgaagcttagtttggctggatatgtaattctgggttgaaaattcttttctttaagagtgttgaatattggcccccaatctcttctggcttgtagggtttctgcagagaattcctctgttagtcttggactttcttgaagaaatgggcttctctttgtgggcaacttgacctttctctctggctgcccttaacattttttcctttatttcaaccttggtgaatctgacgattgtgtgtcttggggttgctcttcttgaggattatctttatggtgttctctgtatttcctgaatttgaatgttggcctctcttgccaggttggggaagttctcctggataatatcctgaagagtgttttccaacttggttccattctccccgtgactttcaggtacactaatcaaatgtaagtttggtcttttcacgtagtcccatatttcttaggggctttgtttgttccttttcattcttttttctctaatctcgtcttcatgctttatttcattaagttgatcttcagtctctgatagtctttcttctgcctgatctattcagctgtcgatacttgtgtatgcttcgcaaagttctcatgcagtgtttttcagctccatcaggtctttatgttcttctgtaaagtggttattctagtaagcaattcctctaaccttttttcaagtttcttaccttccttgcattgggaggagcttgttattacccaccttctgaagcctaattctgtcaattcatcaaactcattctccatccagttttgttcccttgctggtgaggagtttgtgatcctttggaggagaagaggtgttctggtttttggaattttcaggctttttgcactgatttatcctcatctgtgtggatttatctacctttggtctttgatactggtgacctttggatggggtttttgtgtggatgtcctttttgttgatattgatgctattcctttctgtttgttagttttccttctaacaggcctctctactgcaggtctgcaggagtttgctggaggtccactcgagaccctgtttgtgtctacggccataccaccctgaatgcgcccgatctcgtctgatctcagaagctaagcagggtcgggcctggttatacttggatgggagaccctgtttgcctgggtatcaccagcagaggctgcagaacagcaaagattgttgcctgttccttcctctgaaaactttgtcccagagggacacctgccagatgccagctggagctctcttgtgtgaggtgtctgtcaacccctgctgggaggtttctcccagtcgagagggatggggatcagggagccacttgaggaggcagtctgtcccttagcagaacttgagcactgtgctaggagttctgctgctctcttcagagccggcaggaaggaatgtttaagtctgctgaagctgcacccccagctgccccttcccccgggtgctctgttccagggagatgggagttttatctataaacccctgcctggagctgctgcctttctttcagagatgccctgcccagagaggaggaatctagagaggcaatctgactacagcatctttgctgagctgtggtaggctctgccaagtacgaacttcttggtgctttatttacactgtgaggggaaaactgcctactgaagcctcagtaatggtggacacccctcccctaaccaagctagagtgtcccaggtggacttcagactgctatgctggcagcgagaatttcaagccagtggatcttagcctgctgggctccatgtgggtgggatccgctgagctagatcacttggctccctgactccagccccctttccaggggagtgaacagttctgtctcactggcattccaggtgccactggtatgaaaaaaaactcctgcagctagcttggtgtctgcccatatggtaaccagttttgtgcttcaagccatatttcttttattggaaaatatagaacttttccttctcacattcaacttcttgagaggatctctttgataatgtgttcatgtacacagttcacatcaaatatatataacatgtggatcaaagtgttaagatattcttctttacatatagtgttagtagctgacgatttttttttcttcaaaaataaatttggaaacttgtcagtccataatttttttaagtattattttactatctcatgaaatctgaaaggctagaatacactagataactcttgatttccactcctaccctgccatgaagtgataattcacatctggctataacttcataaaaggggcagggcgacccacttcctaaaagaccactattgacttgaagacctgtgtctcttgtctcacttctaaaagtgatttaaaactcaataactcactctgaaatccactgtataagaaatagtaatgtttagggtcatttaaaagaaagattagtttaataaattttggcaccctgtttaacatataaaaccatgaccatgtgttaagtataaccatattttgtgcagaatgtgattcaaaagactgatttaatagctatagtccaagaagtgttgaaaactcttgcccagtttatggtttccaatataggacacatatcaacagaataagaaactcaagaattaaactgatgactgtgtcgacctctggaggaactcttttttaagacacaaagccaaattttcaccttcatttatgcacactcatctcctgaaggcttccttatgcatttacgtgtgaaggaaggagaggatttgactcagtctctttgtctgtcatctttcttcctctctcattctgaaatagcttttcacagttgaggaaaaaataaagatttgaccttcccacagtgaatgataacaatgataacagctgatctttatatagtgtttattatatgacagagatcatttcatgcactttgcttctaagaactcatttattccttacaacactgtaagtactgttatccccattgcacagacaagaaaaatgagcttctgtattagtccattttcacactgctataaagaacttcctaagactgggtaatgtatagaggaaagaggtttaattgactcacagttctgcatggctagggaggcctcaggaaacgtacagttatgtggaagaggaagcaggcatatcttacatggtggcaggtgagagagagagagagtgtgtgaaggaggaactgtcaaacacttataaaaccatcagatctcgtgagaactcactcactatcacaaggttttttgcacagacaaaaccacccccatgatccaatcacctcccactaggtccctctctccacacatggggattatggggattacaattcgagatgagatttggatgtgggcacagccaaaacatatcaggtacaaacaaatagtggagttaaaaatcaaacatggaccatctgcctctgtagtccaggcccttaaccactacattatataacctcttgagagaggaaaacttagattgggcaatattagcatccaattgccagtgcaaaaggaaatggaagtcagcacaccagcttattacttacccgagatcaataagagacctgcaaatacttgactccgggttatagacttggtaaatccaaatgatttctctcatgaatccgaatccctgccagtaatgcagatattctaacttgagacttaccttccagactgaaaatgccaaatgagaaaaaccaagtaagtttgagtttctgcagttacaaagtgctatggtttgaatgtccctatcaaaactcaggttgaaataaaattgccattgtaatggtattaggagatggggcctttaacaggcgattaggccatgagggctctgccttcataaatacattaatgtcattattgcaggagtgggttagttatcacaggagtgggttagttattgtgggagagggttcctgataaaagcataaatttcacccccgtccactccatcttcagtgctcacttcatccttccaccttctgccatgggatcaccatccccagatgccagcatgatgttcttggacttcccagccccagaaccatgagccaaataacttctcttctttataaattgcccagttgatggtattctgttatagcagcagaaaacagacaagacataaaggaagacacataattaccctcccccaacagttcatgttacccctcaacattgttttagtcagtgcaagactaccaaagtataggtgtctgaacatcagggaaatgtaaatagagaaggtaaatgaattcaaccttccttttccctatactctcatttctgtcaaatataaaaacctgtgggttttacccttgttccagtttacataatcacattccaaattacttatgtggacttttatgagggctttttttctttacacctctctccttttctcatcagcctctgcaatcagctttatacaagagttatatttcattcatttcattttcttttctttctatttcacaagttctgggacttggctgtcaaccgaatcttgaacttggtaattaaattgttcataagctccaaacatgttgtaactcatgtcatattcatgtacacttctctgccccaacttgataaaatgagtgatactgggacaccattgtcatacacacctccaaacctgggtgtgtccacttcaaatgcctgaacttgctcaaatagaaatgggattactaaaacaactatatatcctcaccatgctggttttagtaggaaagatgcatcaaggataaagctctccagtgaaaagcatggggctgaaagaaggaagtctctctgaggcagaagtcctttggaaaaactgaagatgacgtcctagataattttgaagtcttatgtagcaacagaagtttatgtcattaatttagcaaatagtcatagacaaaacatgcaactttagagcaagtgccaggctgtgccaataattccacccttcacctccacatggggtcagtccatagaacaaaataccaaaggccttagtgctcaggtcttttgctcctgacattctcccttcatcctttccctatccccacttatccttttttaatgcactatagatgagtatgtcttaatttcttaagttaatttgcattggcattaagcacctactttatttatttcctttctcaacaactctcagactttgattcttcatgtccttccagggccctgccccatgccttctgctaaatgctaaagtcatgcaacagtttagtactgcgtagagtaggatggctagcaaaaggaaatctctcaaaggagcttcatgctctctgtgactcagggtagcagtatatggccttcggcacccactgtgggctgggctatggcagactttgcttgccctcattgctctctttgctttccttgatcttgcccctgtctgtcttcattttctcccttctcacttttttccctattgttacttacagtttaagttatggaagaaaaacacttaatgcttattggccactggaggatacacctcataacttggaaaatgaaaataaacactttaatagttttgtacttgatatgatgactcttttaaacaaaacactttttatctaggcatgaccttagatttatgggaaaagaaagttgcaaagatagtacagagagttcctgtatacctgtcttctagcttatgctaatgtggaaaacttacataagtgtggcacagttgtccaaaaaataaattcacattggtataattctattcactcaaattcagactttactcatatttcatcagttttttcattattatcctttttcttttcccagatctaattcagaataacacgtgtgttactacatgatgatttaaaatgtttacaaaaacaagacctctacctatgctcctattagtgtgtgtgtgtgtgtgtgtgtgtgtgtgtgctggtgtgtgtatatctttatttaataataaaactagaagggcaatgaattcgaaacggaggcttttcttactagcctttttaagatagacattgctgacacatggacagggattgaattagtacaaatattaaatatcattaagccttcttttttgagttctgtctgcacatcaacttcacctgaagaatgtttgtaaaatacacatgcttgttccccacccaaaatctattgaatcagaatctctagggagtgaggaccaacagttgcgcttttaacacctccactccccccttgtattggacggtaaaggccagaaaagattaccttaggcattctcatttcagaagctaaaacagacattcaattttctataccctaatttgggacttatatctgagtgttaatatatgcatgtaatactttgtgatgaatgttaaatgtgttttaatagtgttcccttgcagaatattctttcctttgccggtattattaagactatcttgcattgggattcatgcccccaggcttacagttctctgagctatacttgcatacactgtcctcagtgaacctgggctttggatccagatcgccttgaattcaaaccctagatctgccacttaaagactcaagaaacttacataacctttttgtaattgttctctatctataataaatgaaaagtattactaattattacttacatgcaagattgttgtgagcgtaaaccacatgatgtgtggaaggtttggggcacagcattctttaccaattcagggtaaccctgaaaacttaggaaaaagagaggattcatataaatcacaaattttgcaaatgcattttaaatcctctctttgttccagctccttgtacagacaggactgcttgctactaagaatttccaacacaacctccaattaaatagttctttgatgtatagtgggtacagaagaagtccaacttatttgcatttgcagaatcaggagacccccccaaaaaatgctggaggtgtgaaagcaagaatcagaatttgtcaggattctccgtaaagtactagcggttttgtagatgctttgcagctgtggaactataaacactcaaccgcagacacctcattttatatctcttctatgtggtatatttcccttgtgaaaatgtgtatttttaaaattcactctgcaaaatgacagtcaatgttatcaaatatacatttatatgcccttgattgtaaaacccactacaaagtttattaccttaagtttaatagaaaacaattttgaaaaatgggaaaaaaatatatctgtcacagggaagtggttagaggttctaacagaggagatttcttgttagaataatttgttgtattttggttatacattttttgtttttctttcgaatgttgaaaaagttaagaatatattaatacatggacaggttagaaaatatgtaaataataggttggtcaaatcctgcagatgacaaatcatgagagtttgccaagctaaggggccctggccactcataccatccctttatctaactcttcctcctcatccagtcccataataaaaaatattaagcttgcacgtggtaccttctcttctaggctacttgttaatgggtcctcttaattggctatgtataaaataagattcccatgggcagaaatctttatctgatctgttcatggacatatccaagtgtcaactagattttggcacacagtagatgtttggtaaatatgtattgaatgaatgacagacactgtgctccacattgtaaacacatcatatcatttaatcattataacatccctatgctatcccctatgtgctattattagctccatggtacagacaataatcaggatagatcaggaaactaaccaaggttacacggacagtacctagatggcaggaggccccaaagcatgtgtactaagcattatggcacactgccttcctgtctggcattcttgggacatgcatgtgtgagcgataaggtaagtccaggaaagcgtggggcactgggagaatgtagaagtagggatgatggaatttcatttccacagtgagagccccccatcctgctcccattgtcagacccgcactttttgttatctcttttccttctgtcttgctacgtttgctttgtcttcttcctcgatagtttcccaaagactttaaacgactaactatcaaagaagagaatatatgtgaagtcactagttacttttctgctcaattagctatatatagattaactttttaaaaaaatattttccccatacacccactcacataactgtgaagcttaggaaaaatttcaagattatcgtgggtgggccccatataaatccccacactgtcaattctcccagcagctgtttcttaattcgtcatcagtgtagaaatctaaatcagcactcagtgaaatctaaaagtccaaaagatttatttcaaatttcaaacctcctccctaatgttctgaggctgtgtcaacacaggtagagagacggggagagctgagggtatttaagaatcacataatgtgagaaactgaggagaccctagggatcttttagccctaccccctcatttacacataaggaaatgggatctgaggccaacagcaaacttgcctgcctgctatctgggaagttctattaataacacactgtcatgggggaaaaaattcatacaggtaataaaggtttgttattttcaaagattaacattctttattaattaccacttttttgaaactgacacagccacaaaaaactcctgtataagaagaatttgtctaataaattgtatgattgtttattgggtatctgtttattttcttaatttttaattgtctgtcaatccttcttgatttaaagtagtcacataaatatataaatgtaaagagttaatataactaattgaattcatttgagggaaaaaaattaaattttctttttaaaaaaagaaagaaaacattaaagacagaggtaacattagcacaaaaaaatgtgtataatcaaagtctagagggaggcctaaatgtaaatcaagctttctagtaagcaaaaacaaaagagaaaacctggttaactccaaggttcagaattgctgtgatatgcagacaaaccagctgtgaagacactgcacaacagtctatgataaaaagacgggagggacatttcttgtttgtatagcaaaggtctacaatttgcaatgcactgtggtaaaacagaaaccataagctgaatgcttttgtcactgaacttatattttagttagaaaagacataagaaactaattgtggcatttaacttataatttagttagaaaagactaaaaaagctaactgtggcatgaatgagaaagaaattactgctctattagtggttccaatactgtgaggccacaggaaaaaaaaaaaggattctgaaagatacggtttggaaagacttcgtggaggaagtggcatatcaacagggacttgaaggctgcctagatatgcaaagaaaaagttcaacggaaatacaggatgaaagaattgggtggtcaaaggaacaaacccacttgctgatagattgtcaaaaagtatagtgtctgcactactatgtgacgatgacattttttttccctttgtcatctaaaattgctatcaggccgggtgcagtgactcacgcctgtaatccaagcactgtgggaggccaaggcaggaggattgcttgtgtccaggagtttaagacaacctggcaaatatggtgagacctctctacagaaaaaattttaaattatctaagcatagtggtgtacacctatagtcccagctactcaggaggctcagataggaagatctcttgatcccaggaggtggtggctgcagtgagccaagattgtaccactgcactccagcctgggcaacagagagagaccctatctaaaaaagaattaattaattaaaaaaataatattgctgtcagtaaagactgactagtctgtgtgatatttatcatagctatatttcataactccagtgacctttttaaataaaaagtaaggtccagttgaccctccctgtctgtaggttctgcatacattcaaccaaccatgggtcaaaaatattcagaaaaaaaaatttaaaaatacaataaaaactaatgtaggctgggtgggtgcaatagctcacacctataatccttgcaatttgggaggctgtggctagaggatcacttgagctcaggagttttaggtcagcctggcaacatggtgagaacctgtgtctactaaaagtttaaaaaattagctgggtttggtggcatgcatctgtagacccagctactggggaggctgagatgggaggatcacttgatcctaggaggtggaggctatagtgagccatgattgcaccgctgcactccaacctgggtgacagaatgagaccctgtctttaaaaaaataataaaaataaaaatcaatacaatataacaactatttagatagcatttatgttatattaggtattacaagtaatctagagatgatttaaaatataggaaagaatgtatgtagcttataggcaaatactacgccgttttacatcagggacttgagcatttgcagattttggtatccttggggggtcctggaaccaatactttgaggatactaagagatgattgtccattaaaaatgttttaccataaaggaaacattttatctcttctgtgtcagtctgtgaccttttgggtggaatctgaacaatgtgtaaatgatagtttcccaacagtgtgcgctgatgtgtaggagtagaaaatgatcctttggttttcatataaaaactttcttatgaaacatgaagctaacaaccaagaagattaatcccaccagtgagacacaaggaatgcttaattttggaagtgaagctacttcctcatccctgaggcagcacatacactttttcaataatcctttatttaacaagatccaagaatattaatatctaacagcttagcctaaatttcttgaaaggaccaagcccattgtgttgtctcctgacttgattttcccaaactgtcatggattttctatctaaggaagatgagttccttagttctgggaaaacaccattgaggaaggatgcttcagaagaggaagggatgtcagccagggcagataaaattagcaagaaatattaagattaagtgctatctaagaggtacaaaaaataatagtgtttcacctcaatagaatcttattgttaaaaatacagtgtatctacagttctgaagattatcaaaacacaatattctagccccaaaacaggaaaagaataatgattcttaagaaaaaattctttctgggctgggtagggtggctcatgcctgtcatcccagcactttggaaggctgaggtgggtggatcatgaggtcaggagatcgaaatcatcctggctaacccagtaaaaccacgtctctactaaaaatacaaaaaaaaaaaaaaaaaaaattagccagacgtggtggcacatgcctgtaatcccagctactcaggaggctgaggcaggagaatcacttgaacctgggaggcggaggtggcagtgagccaagattgcgccactgcactccagcctgggtgacagagccagactccatctcaaaaaaagaaagaaagaaaaaaagaaagagagagagaaagagagagaaaggaaggaaggaaggagggaaggaaggaaggaaggagaaagaaggaaggaaggagaaagaaggaaggagaaagaaggaaggaaggagaaagaaggaaggaaggaaggaaggaaaaatattctttccatccattacacactgtaatgtaaaatgatgtgtcccagacaatggtctgtaaaccacattttgtaattccattgtaaaagataatgtagtgcgagcaaggccaaaaatccactattctttggaaaagtgtgccatttaattccactgaagataaggcagttggcacaagtcaacttttccccctggcttagatgtagttgtgcctttcaaaatgagctctctcatttgccaaatacaaagaagagaatagtgttttctcagaggaccacaggatatcaaacataattaaaaataaaagtaagattccctttgaatctagaagaaaactcacccaaatttcttgtaccaaatgaaggtatactgcagattttatcacagtcattaccatgagcagtcaataattccctgaatccctgttggacagaattacatcaggtacatgtgttgtgatgttttctgttttgagttctgtttgttttttatttattggtaattcagataatctcagtttcaggaatttgttttcttctctcctaaaatggagctgatgttcatctcttccttatgttatacctgtatttatgcaccaatttcatagaaaaccatcgtgcattttcccatggaattttgggtgacagtttaagatcagcgtttactataatgggcagacttaaaatggtccccgtgatccctgactcctgaagttcactcccttgtatgcttccccctctttgaatgtcagcggacctttaacctagagaatacagcagagttggccagatatatgtgattccatggttatcttatgtaagattggagtgcatgtcttgctagagtcttttacttccttattgactttgaggcaccaaggggccatattggggaaccccacatggcagcctccaactgagccaccaaagaagtgaattctgccaacaatctgaaggagcctgaaagcacagccttccctggttgagcctcaaatgagactgcagccctagccagtactttgattacagctttatgagatcctaagtaaagaaacaagcataactgagtcaggattcctaagccacataacccgtgagataataaatgtgtgttttaagtggctgtatttgttatacagaaataaaaaatgaacatacttactaaaaaagtttttagctgttgtgagtcctggtaattggatttgttttccagtgatatccatggacactgtgtcaatagtgatgattgatgctgatttgttttactcttatttattcaggatctgggtattaaaaataaattcaaactttcaacaggctgatcacctctgcccctctccctattagcatgtgcatgtgtgtgtgtgtccatgtgtccatacatgagtgaatggatgtgtatttaagcttaatcatgacacagggggttgtttatacagggtttttagaaaacaaaaacattgtctctatgaggcagttccttagaagccaactctcaacagtgtctcagtgtttccctcctgtaatttttccacacattatgcactggattttagtttgtgatactcaggattagtcatgaaaccaagtctttttgtgttctatggtttgaccagccctgtgcaagtctccagggaagcacgaaggacgggtaaatcagagtcccatcccttgaagcatggtggtattagaacatcacttaaagaacagggatacattacccatttagtgaaataatctagaagtcctggaaactaacttagctcacaagatgatattcattagccaatttacttcagaaactttaagaaaatcactttacctcctctgtacattcctccttccctccttccctctcttttcctctctccctccctccttccctcccttctttccttccttccccatattgttattaaatatgctcattattagaatagtatcaaagacactgaggcatttttagatatcttgtgaaatactccttatttttgtctcttcctttagatatcttaattatcaaaataatctaataagactctatttggaaataaagtgaaggagggtaaagttgtgtttttaaataggctgatcagtgctagaaataataggatagttttaaattctagcaattatagatcaaggctccatatactatttctaaaaagtctgtgaacccctgggaattgtgaatgtttcccattacatcctgccaacgattcttattaacctattggtgacgtctttcccagaggtgaagctttgatctgcttgtcatctcacattctgtctcaccacagtctagagcttccaggtccatggggaacaaggatggggcagcagcttccctgtgccaggactgactgggaaattccagaattctatgaccaggtacctgggaagggagaagagctctctgagttacagttagtctgggagcttttgaagtgaaactgtcatagggaaagtgaaggaatttgctttgtgcaatcatcatgccatagtctgacaagacaatggaaaaagaaagaaggaattttctctcaagatgtcaaataattagctgagtcatgaatgcaagcaggtaggcagaaaacagatatttgtagagaacttatttctctttctcctaatgaagtttttgaacaacaacgataaaatggaccttttgcctaagaagcaatttaacaaccattgcttcagtaacacgagaaccaatgtgattagagtgcttgtgctctgtcccctcataaatggttagtattgaggccttataaagaaatataacatctgctttttatacataaatacctacacgtaaccatccacaaataacttacgaatacccataataaacacagaatccatcattatgttaaatgccactgtgattctgagcattttaatatgctgtgaaggcatcagagtaaaacagaaacaagttatatctaaataggaatgcccagtacatttaaagtaatgagacgttttgctaaattcatatgttagcaatatgtcatgtggagtcatgaaggatcagaaataaaaaacagtaattgtccaagccgtcaaggagggatcagaagcaggctttgatcccaggctctgagtagagttgctgtggaattgtagattacatagaatacaggtggcatcaccacagattcctgtttatgtatttaacttgtaacttctcattctgacatcacaggaatatttttccttaacaaagtgaaataaaaagtaaataagctctttaatattgggacataaccaaatcagagggcaacacaaatttacatgggtacttgtgaggcaaaagaaagaaaattcaaaattcacttctaaaaatggacattgtttaaagcacatttaataagtgttacagagtgatgtttcactgtcacctttaaataccccttactgtttctttgggattaccaatttcaacatgaaggtccgagtgaactttgctagaggtgatttgcacaggctcatatgcatctcttcctcatattcagtgacctcacattagcagctttaaattggccatgttgagaacattgacaccacagaaattggcaaaaactagaaatcaagtaacacatgctacaagtctttttttttcttttctcccttcttggaaaattgtaatccagttgttaaatatttatcattataaagtagatccttgttaaaaatattctaatcctcaccaatggttttattttctttctgcctctcttctgctgcccctaaattaaagtaggtctttttatttggggctaagactagttccatcaaaatataaaatagatgaaaagtgttttggggcctttttgccctcttttcctagaccttttctgtttctcctcttgtcaaaatctcacttttttcctttaccttttcagccctgcttcagccctaggtcttcctaaaccagagaattttccaaaaactgcgtgaatatatatgccacaggctgaaatagtcttcccaaaaattagtcattaaaaaagtagagaaagaagatataagttttacatgaaaccctatatagataggagttccttcgagtattttcaaacttgattaacaacagagtaaattatttaagaatgatttaagaaatcaaagtatgagaacttggggctgatccaaagatgtggggattcagagatgaggggcaggcatagaagaggagaagagactgagtatttgtcaccacgtaaattcctgggcgagttgggtaaattttttattataagaaaacactcctttttcttctatataaaatttttttcaagtgagttgctaagttcattgtgagtcatgcattcctttgttcaagtgtggacaaatggtccttattttgttggaattttacactggcagagatcaatggtacaacctggtgaaccccccacaccaaagacacacaggtgtacttaaaggctgatcttctacagtacgcatctatggactggctttggggtgtgttcccaaacactcagagccaccttgagctggggaactggttagtacaagtctctttatgtgtcccttactctacaatcatgcacctagggtcgtgcaaacatcctgaaaccaacccaagctctaggagtcagaaaaggccctgaatgcatcttcaatacaggatctgtgcacacagcatggcctgcttctagaaaaccaatggggctcagaggcagtccagacagaggccttattttaagggctgatagaataggctgtgtttccccaacagcctaccttggtgagtaaacaccaacaattaattcatttatttactcactcaggttagaacattgtgttttcaagtttctaatattaaatttctttttcttttttctggaatagggactatcttattcagctcaaaataccatagactgaggcttaaacaaagacatttgtttcccaccattctggaggctggaagtccaaggtcagggtgccagcctgcatggcgagggttctggtgagaactttcttcttggcttgcagatggcagccttctccctgttcccttacttggcagagagacagagtgagccctggcatcttcctcttcttataaggatgctatattccatcatgggggcccaaccctcatgtgcttatttaaacctaattacttcccaaagaccccacctccaaatatcaacacattgggagttagggcttcaacccatgaattggtagaagggcgggaggtggacacaaacgttccatccataattctagctggtaacatcattgttagaatcagttgccttgccagtctcagaaaacaggacactgagatgcaaagacatgtacatttccatttgaggcaggtgccaggagacaactgagaggacactgagtttagaacattggatcaggcattgagagggaatctgggttgctggatgcaagaggctagtaaggggtgatgagagttcttcacataaatcaacctataactcacccagcctctgtgtcccaggggcctatccattattgatcaaaatgtcagtagaccttttgggttgtgtttcaaagagtaaccattatcttagagattcatagcaaaatatgagtggttcccagtaaaataaatcagagtttcctttatcttagctagaaacacctattgggacttttgtcaaattatttaggggaagaagaaggttgaaagcaaacttccaattgaaaagaagcatatttattgaagttcagagggctggagcgttgttttttgattgacaaaataatgaactctctgataagagtccagaattagttggctgaatttgtattcatttctccataaatttgccaaagttagaagagaaaatccatagaggccaaatgaagaaccatttgattaagcgtgttatcagcctggttgtggccaaattccacctcatatattcatgcacacattctttgctatgagttgcatatgtgctttgtggttgtgggcagatttaggtttgtttttctttctgagtcttttctggtccaaaagctcatcatttaaagttttggaagcaatttagaaagctattagattcccaaccccctcccgacttttggaacacttgcagttatttttttctggcacaaaaacaatcaaaaaggaaaaaaatgtcaggatatcttccaaagagagacataaaggtaacattttatttataccatgatttgtttattcttatttgttgttaccataaaagttatttaatttttttgaactgaaaggcagatgattttaggggataaaaaacctaaaataagaagtgttgctatgtgattacagagaatagttgcttttgttctgcctgtgtttaattaaagcaccatttgagaaattcaagaatcaggtggtaccgttgagtcactggacacatttttaagcaccatcttgaaatgtgatataaattgattttaaattttaaatttgtaatcatacacttcctctaaattgggaatcatgagagcatttctttttaagtagtttgtgataattttggaatttgaaagaaactttaaaggtaatgtatttaaagttactcacagaaatatgctggatgtgttgactggtaactttaaacatgtttatattgctatttttctagcacttgaaaagtaatcatgttttatagccaaagtcatctcctgtccatagaacaattaatagtcataattgatagttttatgcatgaaaattaagtattgctcctgcaaaactgaggagttaatgtctttacgtgctttttcacaaacattccttataatggaacaccaaatgcctacaatttgaacacatggctggtggaaaaaaagaagaaaaagaaaatcaatcctaagccagaaatctgaaaaaagacagtgactttgggtcattttgtaatcatctttggtgcttcagtgactaaaaaatacatgcagagtgcaagagcaccttgctgaatcctacaccctgccctccttgtgcagttatgttacatgcaactccaaagcctccacagctgttgtctctactctccattcaaaacaatgcacgtgcaactttcccttgtggctggcttcgtcctccacacaccaatgctttgtgtgaaaaggtttcattaaaattgagtttagggtaagtacgggataggtggagaaaagattttcttctaatgcttctccagaccacactgtttagccttcaggagacccaggaattgatatgagcaaaatgtttttacacatgaactgttctttaatcccttttttgcttcttcaatccttgaacttcattccctttcttttcattaacatttacaacacacactttacagggaaagaaagtgaaagatatgtaatgattctgcctgctacatctgactgtactccatttctcacattctatcctcatctttttctagccacctgagtcttcagacagttttaccatcttccctattttaaccccaatttaaacatccacaggaagccaaacaaaatatgcccatctgctccagatgtgtcaaatcaagttctgctattttaatttttttccaggcaaaccctccaacaaatgtataaacaggttgctttttagaagaagtaaagattaatgtctctctgggaaaaaaaaatcccatgcattttggaaagtctggctgttttccccttcaaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccagggtctgcgcattcagcagtgagcaaaataacacaaaatgcttgctctcatgaacctggagacagacggtaagaatatacagcgataggcaacatggtaggtggggatgagtgctctgaattaaaataaggcaggacacagagatggagagtgacctggacaggacagggttggcagctcagaagtgcattatctacagtggtcagggaagcctctccagtgaaaggacattaagacggagctgaaggaagggagagagtggatgaaagagcaaaatccctggaactgggacatgcttggcaggttgagtgtccacaagagccccaattaactacaggagggtgagcaaggagagagtagagggagttgaggttagagaagtaaccgtacgtcaaattatggaggactgagtttctcaaactccagtgtctgcgcaaatcccccagggatcttgtgaaaccacaggccttgatttagaagatctgcggcaggcccagggtctgcattcctaccatgcccccagatgatgcccctgcctctaccgttccccagaccatgctttgagtagcagagatgaaggccttcttgcccacagtacaaattctgctatttctttcctgttaatttgaattggtatgcaacaactgtacatatttatgggataagagtgatatttcagtgcatgtatacagtgtgtaatgatcaaatcagggtagttagcatatccttcactgtgaacatttatcatttcttcatgttgtgaacattcaaaatcctctcttctagccttctgaaaagataccccagagtattgttaaccatattcaccctacagtgccacagagcactagaattcattcaccctatctagctgtaactttgtatctattaaccaaactcttttcatctttcactctcccatacccctccctgcctctaatgactacaggtctatctctgtttctctgagttcaatttattttagcttctacatatgagtaagaacatgtggtatttgtctttctctggctggcttattttagttaacatgatgttcttcaagctgatccatgtttgctgcaaatggcagaatttcattcttttttacagctgaatagtattccattgtggatatgtaccacattttcttcatccatccatctattgatggacacttagattaaaggtactctgcttttactatgagtgaagtggaaattttttgaggcttttctttttatgagacaggatctcattctgtcccccaggctggagtgcaatgtcacaatcataattcactgcagcctccactcccagggcacaaatgaccttctgcctgagcctactgagtagctaggactacaggtatgcaccaccacaccctgccaatgttatattttttgtagaggaaggttctccctgtgttgatgaggctgctttggatgcttttaaatagtggggaaataggatcagactcatttttagggagcccctctggctgctctgtgaaaatagggcaagggaggaaataggagacctcctgggagataactggagtagtctgggtgagatacttcagtgccagcatctaaggtacttgcaggtgggacagccacaacgaatgccacttcaagtgaatgtgaggatcagctctgctgcccacgtggaaacataagtaaggttgttacctgtggccttgcagaagcctgcaagtcaaaggccttttgatggttggtgaaaatcacatctgatatgcgtgattccaggaagctcatctgcctcattcctgaatttaatttctatccatgatgcacatattactattgcattaaacgtgaagtcattgcctcctgccattgtaatgtatgcatgctattgcagaggaaatgtttttatctacctcccaaataagtaagcataacttgagctcgcattacaaaatgacacaataaactaaaaaggaattcatttaatatttttaaacatgattttggtgtccttatatttagggaaatattttattgtaagttcatcttacaataaaatttataagggaaagatattttattgtaagttcatctcaggacaagaaacttcacttggcatagaaattaacatccaatctgcagcctgtcattgtagtgagatagtcttgaattccctagctaagttatttacctaaacaaagtcttgttcactttgaatttcctagctaagttttttacctaaacaatcattatatatgtttcaaaatatttaaatttttcccttccctctgattttataattttcttgataaaccttcctaaatatctttaaatttcactgatctaatggttcttaaccaggggtgattttgccccccatcaagggatatttaacaatatctggtgacatttttaactatcgggagttgggggatgctactggtatgcagttggcagaggccggggatggttaagcattctgcatacctgggagggccttccataacagaggatcgttcattccaaaatgtcagtagtgccacatttgagaaaccctggccttctggtgaccacaaggccttcagctacagaaaataaaattcaccaaagatccccacagccatgctttgaaatccttcacagtttgcactgagccatgcttcccacaggctgctccaatgaaggggattactctgaaggccagctttggctcctggattctccaacatccgtgccaaacctttcttatgcagcacagtagcctcagacatttccagctcactcccacttttctctcaggacatttttcctataaaattcttgcacatttaatctcatttagaatctgtttctcagagatcctggattaatatatcatggcattaaatcattgaaaataatgaattaatgatctttcctcattgtagtgatatgggaagaaaacgttctgatacacagaacacagaaatggctcagaaatgagaaactgactgactactaaattgttagtaaaagcaacagaataagtaagtgaaaaatagagcaatttggggggaaaaaaagttgagaaaccccaatcttcaaaaaaaggataaaagtcttagcttttgttcatgtgttatttaaaacccaactcaggcctcaactgaaacaactaaaattaggaaccaaaattgcatcccctgcccattcacacttttggaaccagagtggttctggacatagtcatgaggtcatcattcctaattagagtaggaatttcaattcttgggtttctaacccaaatctcgctatcctcagaaagcttgacagtatttgcagctctgcccattagatgagatctaccctttgcctttggtcaggaagagtcctatgtatggacacatcaccacagaccactcagattccctcttaccttccctaggacactctgcctcccttcctcctttccatgatactcatcactctgggtagactctgcccaggcaacaattgccctctgtggtttgccaagacccatcctgctttctgggaatagatgagtccctctaaagatgggcatgtccccagccacccaccactgtgcaggtggcagctgacgtctattgtcctgcaactcacatatcctgatctctgctctgttatgaactccagccagagaaatatacagatcttattcctgattcataagagactgtgtttgccttggatttaaccaggtctgatgactttcaggatttattatgttgatgaataaagggaaattctctcccttaaactaacacaatgatctctctgaatcagattctccctatacgcagccagcaatactagagaagccccagagacgctgctacttgagggctggcctaccgcagagctggcgtttatgttgtgatgataaacattcttgaaaaaaccctgaaggagatcctggcattttcctagtgcctttatgtgccataccgagtgcaagctgcttttcatgtactaactaatttaattcctgcaagagtcctgtggcatgggtatttcttattcccattttactgacaaggacactgaggctcaaaaagttgtttttttgttttgttttgtttttgagacggagtctcactctgtcgccaggctggagtgcagtggtgtgatctcagctcactgcaacctcagactctctggttcaagcaattctcctgcctcagcctcccaagtagctgggattacaggcacgtgccaccacatccagctgatttttatatttttagtagagatggggtttcactatgttggccagaatggtctcgatctcctgatctcatgatccacccaccttggcctccgaaagtgctgggattacaggcgtgagccaccacgcccggccaaggctcagaaagtttaagtgacttgcccaatatcacaatgttagtaagtggtagaggtataatttggattttatttgaattggaaaaggctgtgatctttctaggtgatattctaggtaacactagtttccagcaggcactctccattacctgcgtctgttaggtctgagtctgctatggttttctgactgatgtgtagggtaacacaattaaggaactctccactggaaggccaagtctccactcaggcacgtaggtagctggcagtcctccttgattctgctagccagagccagcttattgaaaacaaaagcagtctgttaggacagtgcccagacttctgacttcactacggaggctaggaaccaagtcaatatcatcagtcattactttccatcaacctctatcatttacatgcagtaggtgctcagtaaatgctgataaattcctgtatgaataataaatgaatgaacaaacaagagcatttgtctgtacaagttacagagttttagaatagaatgtaagtgtgaagctcgataaattcaaacttctgcaatatccccaccaagtggttatctaaattccgtttgacttcccttggcagggaatacgcacgcacactttctaaaggagtttttccacttcatatgactctggctgttcagaaggaatcactaattaaatgagatctttgaaaaaagtcaagaaactggaaataagtaggaattgctttacctgatgcttatcagcttacaggctttactgctccaaaaatttggttcgatttgaaaacattatgctaagtgaaataagccacacacaaaagggcaattattgtatgattccttttatatgaggtacctagaataggcaaattcatagagagagaaactagaatggagattcccaggggccgtagagggagagtagttattgctgaatgtgtttggggtttcagtatgtggtgaaaaattctggatacagatgctcacatgtcattgtgggtgtctttcatgcaactgaattaggttttttttttgtttttttttttttttttttttttcagataaaccatgaatcacattttatttattttgtcctttcatttttttttttttttttttttttgagacagagtcttgctctgttgccaggctggagtgcatggtatgatctcggctcactgcaacctccacctcctgggttcatgctattctcctgcctcagcctcccgagtagctgggattacaggtgcccaccatgatgctcagctaattttttgtatttttagtagagacggggtttcaccgtgttagccaggttggtctcgatctcctgacctcgtgatccacccacctcggcctcccaaagtgctgggattacaggcatgagcctcaacttttattttacgttcagatggcacatgtgcaggtttgttacatgggtaaattgcatgttactggggtttggtgtacaaattattttgttacccaggtggtgagcatagcatagtacccaataggtagtttttcctttttttttttgagacagaatctcgctctgtcgctcaggctggggtgcagtggtgcgatctcagctcactgcaacctccgctcctgagttcaagcgattccccctgcctcagcctcctgagtagttgggatgacaggcacctgccaccaggcccccataatttttgtatttttagtagagatggggtttcaccatgttggccaggctggtctcgaactcctgacctcaggtgatctgcctgcctcagcctcccaaagtacttggattacagccacgagccatggcacccggctggtagtttttcttcctcatcctcctcccaacctccaacctcaagtagcctccccccaacagtgtctattgttcccttctttgtccccatgtgtacttagtgtttagctcccacttattaagtgagaacatgcagtatttggttctctgttcttgcattaattcgtttagacatggcccctccagctgcatctatgttgagcaattaaaaaaggttaagatgagctaagtgaggtggtatgcatctgtagtaccagctactcaggacactgaggcaggaggatcacttgagcccaggagttcaaagccagcctgggcaacatagtgagaccccccccatctcttttaaaaaatatttcagatgataaattttatgctgtatgtattttaccataatacaaaattggttgaagaggagtacatataaacacaacaacgaagtgtttaactcatcaatttcagatacacagtaaaagaatgtatatgagaattggtcaaggacattctgaggctttaagcttcaagtcaagaaaaacaactgcctttctgaaaacttacaccgctcacagagtctggtgggctatgaatttgatggtacaacttctaacttgacagtgtggagatcaagggtataggaatgtaaaaagctttgaaaagtttgagagtggagtttgcacagctggacacagggcaccacaaacacaggtggtgcatttgtgcctttggtggacaaagtatcacccacaatgcacaggcgcttccctggctggacaataggtctctctctccatcccctctctctctgtttcaagagaagacattttacgtaggaccttccactctgaatatgaagggtatatcatttccctctcaaatccagactcctctagttgaatggctgacagccaacagaaggggtgtatgcacccttcattaggccagatttactgtccgccttccatgagtggttcagcatgctctctgtccagctgtggctcctgcctgcaaagcgtgccatcagcttcctggttcagagagagctaattttctctaattgcttccaatgagaggtgggaggcaggagggtatgtgccccattcagagccgctgttctcatcagcctcaccaagcagtgagagcagctttcacattcaaggtcttctttccattatttgggtaaaaatgttttgtctcataacctgggatttaagaatcttcaacaggttgcttaacccttaaagatctgacccacctggcctttaatagatttaaagactttatttggttttatgatttttaaaggaatcataattcctacttatttaagaactttaattcctatataagaataatttattctcattcatacttgtaaaaaaagtgtatccattgttttagaaaaggggaaaatagaagacaggttaaaaaagaaaactaaaaggcatttggtgttgcttagatgtacatgttttgtagtatatatatgtggttttgatcataaataatgtatcaaagacatataataccaatttctgttcttttttctgaaatcttagaattgagtccttagaagaaataccaagctaaagggcatgtgaatttctaagtttcctggcacttaattccaaattgttattccaatttctagtgtgccatactacatctttattagcattcaggattatcttcttggttaatatagtaaaatatcattttgttgtttgaattttcattgctttgataattgatgatatttaaagatgtttaggctctttttttctttttcatttgctcagcttttctgaaaacctttaggagacaagtttctcccaaattttttctactgagatttatgcattactgatatgacttctaacatataagctagttaacatcaagaggattagtctatcacaccacttgtcacctggggcaaggtagtatccagttcattagggtaaaggtcaagtaagtgttttgtttgtttaaaggggaacacgggtaggagttatcccaaagttagaacgcaatgaaacccaactatatagtaaaatatatttggggctcaactctgttagccatcaaaggtagtacaaaacatcagaagatgaagagggttttgaaagaaagaagggccatgtcagattaagaggtagaggaacatcaagataatttttcttctattagagtttctcttttagggtttctattagagtttctctaatagggggtagagaaacagcaagataattttttttctattagaatttctccattagagtttctcacctgcaaggtgttgactttccagttacctggcatttcattctactttttggaatggcctgagctgaaattaatcaggctctgttgatgatgcatccaccagggtttcccattggatgcttagaaaaaattccatcacagaatatctgtgtcttgtcttcttgggggctaggagatcccccaaatttttctcttctgttcttgtttgataaaggatgtgtggaggacctggtgcttaagagtttcagtttgacataaaggtactagttctggagagtctcttgggccactttatgttaacaaagactctcttgatcagcctttagttaagcttctctgagctctctccttgactaggcttcaaccttgggcttctgtgtcagtccttgtggagtctggttttagcaagaatcttgcaaagtcagtttagagagaataccccaccttttatatctgatcaatttcctcaatccccacctgtaatgtataagcccttgacctgccttgagtagaaatctcctacccttcatgtctcctcctagtaattttccatccactgaccccacactctgctctttgactctaaatcttcatttgtccttgttgtcttcaatgtcgaggccaatctctttcccctaccataatatctctattgaaatagtcctgaacaaagtcttccttgccattttcacacgtgccagaataatgcttgcctccctgcctgcctgccttccttccttccttccttccttccttccttccttccttccttccttccttctttctttccacagaatctcgctctgtcacccaggctagagtgcagcggtataatcaaggctcacagcagcctcggccttccaggctcaagtgatcctcccagctcagcctcccgagtagctgggaccacaggcacatatcagcacgcttggctaattcttttttgccttttgtttgtttgtttgtttgtagagacaaagtttcactatattgcccaggctggtctcaaactgctgggctcaagcaatcctcttgcttcaaggtcccaaagtactgggattacaggcatgagccactgcacccagcctcacaattttttctttaacaatgcccagagcatatgctgagcttcccgtcactctctggggcggaatggaatattacacaactggcacggtaaagaatgcacttggttttggtggtggataacattttcctttgcacctgaagcacttccacaaatagcccatttgtcctccttgcaattaaattagaaaaactgtctctaagcttggtttgacctatctgtagctctttgaaaagactgcttgatctttcctcactctccgtgtacctaaatcttgttcaggctctgtccagaaatcaataggaaacataaaaccttgaagcattataaaatcaggcattctaaactggaaagggcctttgattatttagcccaaatgcatcacctgttttacagacgagcaacctgaagttcggagaggtggaacttcctccaggtcatctgctgcactggtgatagaggcaggactaaacactctcggtgcagtgttccttctctgagtcatgttgactactatatgctcattcacagtcacaaactaaaaatctcagacaagtcaaaagcatacaattacaggaccagaagactcctcagtgattatctgggagtccaggcatccaagggacttgaccaagtttttgcagctattgctggtagaccaagtacggaaatacacttctcttgactctcagtctagtgctcctttccctgcagtactctgtgcaataccaaaagatatggatctccaggattggctgaggttagcaattaatatggtatttttagtcatgtctacttggagtagggggtgctgatttttgtttcatgtgtgttcttgagactttttgatgaggttccgtatgcctcactctaggtgatgtttttattagtaccatgttgtcttcctataaagagtttttatggcgaacagaaagctgtctggattcttgctatggttgtaggcaggagggaacatggtgtgtggcttctgaacaaactctggctgctctttaagttcaatgaagtgaaaaaaaggcaagttaattgactacagacatatgcaagagagctctcaattgagccataagatcttttgggatgtgggtgtttacaaggtagctataagcactctcataagtactgcacctgtgaatcatggactttcattgtacatagctttccactgcttgcttcttgaggctactgttcagcccatcagtaatttttaaagatcctttagaaagttatatagaggaatgcaaatgtgagtaaacaaggcgcctctacctactgatggcatcttcaatatttacattggcccgttgagttttatcagctggatattgctataaaacacatcacctgaaaattaagtggtttgaaataatgagtatttgtagttgttcacaaacctgtgggtcagctgggcggtgctgcagatctgaaccaggtgtggctgatcttgaatgggctctttcctgctgcggaaggcagccagcaaggtaggtgggggctgatggtcagggatggcctcactcctatgttttcccattggctgactatcagccagggctgcagtgatgactggtgaaatagtttggatatttgtccactctaaatctcatgatgaaacttgatccctacagttataggtggggcttaataggaggtgtgtgggtcatgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggctcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctgaaaacaaaacaaaacaaaacaaaaaaaacctccatgcttcttgtatagcctgtagaactatgagccaaataaacttattttctttataaattgccctgccacaggtatttcttcataacaacgcaaatgaactaagacaacaagtctctgtgttctccttcatctatcatactacccgaggtttgtttacgtggtaaagacaaggttcggagagaaatggttgaaaccagcatagcttcttgagacacaatgacacttatgccacatgctattggccagagcaagtcacagaacatctggattcaagaggagggaaatggattccacaccttgatggaggagatgcaaagtcatatcacttgggacatggatacagggaggggtgcaatttgggatgtttttgcaattaacctaccacaggcttaaggaggcttttaggatttaccttctgctctaatgagtttcaaccaccatggcttagagaacatttcttaaaactcagtcatctttcatgtatccattgttctccaaagggactaagttttgttccatggtcagtcttttccatgtgttcttggaccttatacaaaacccaagcctggaattacagcacctggatttattcatcaagcattcgccagttcctggttctatgcatgtgttcacaaaactcagaacagggcattcctctgaatagagaagaaaaatagagtcagtcagaaaagaaattttttgtctaagaatacaatccaccgtactaccaccagacttggttccctttcaatgtcgagagtaacacattccttttatgtgttgcttaatttgcttgttttaagcagttccttgtttttggagtgtcttttttgataacattgagataccacatccactgatcatgtctaaaagctgacaatttctgaaggaaataaactgttcaaaattaactactctctcactatatatatagcattgtattttcagtacacatttttggtacacatattcgtggtacatattttccagctggcttgtgctaatgtactagtgattagaaccaagactaagaaaaaagtgcattgccattttcaatcaacgtgggtagagctgaatggttgattccaaatcaagttattttgcctaaagcaagacagataggagagagagagagagagagataatacagagatagataatcacaaactgccatttagagaaaatcattactactatcaattataagagtgattagcaagtttatggatagcatgatggctagcaatctttatacaaatgtggctgattttcactaagtcttttaattctcagaattgtttcatgacttttttggagaaaattgttgaggcatgaaaagaatttcatgactgagatagatattgtaccttaggaaatataaaatttaacaaatctgtagaaaaggaagacttaggctttgactttaaaagcccattccacttacaagatttcattttttgtttattcaatttggaaagcacattttcttatataatcaataagaagatttttatggcatgctcgagtgtagtctgattccaggtctcataattcctttgcactcaaaaaaggaactttgttacatcttgccactcatgctcactcttcagtgggcaaagtgactttgccatactgtcaccatccttgagccactgcccggtccttgaaaactaggattcttcatttccttttgcatcgtcagcgtgaggaaggggagggggaggtaagattctggacagctggactgaaaacaatggaaaatccctagtaacagcttgaatcactcactagcaggaggaaaatgtgactcgtttcttttcctctttagcttttgttgatttttttcataatgagctcagaaagagggaaagatcaatattcatgttgagttggtatccatcatagtgatattcagtgattataactctccaattctcactaggacaaatataaccacgcaaactggctaactgcacttgctggcatggttcctttggaaactcctggatttctctgaattacaaacagaaggagagttatagattttgtctctttaattttctgtctcttgaaatctcagatcacaaaaattgagtctttcttaactggtgatttcttattcgtcaatgactccttaaaagatatgcagaaagtaatggccctctaacccttcacctttgtaagctctttaatcctgaggggatggacttcctgatttctgttctctcagattctaaggaggaaaagactagctgttgtctctcaagtctacctattgctgtcctacagagcaaggacccctcttgttctccagctcctcaggaataggattcttggttccctaactctaaaataggagctcacaaggttattgtcaaggacaaatgagggcagtgttaacgtattaaaaaaaaaaaactagtcagagattgcttgattttcaaacttgatagtatgctttcgaagttacataatcaaaattatagttgtatttaaaatgttaagttcagcttacaaaccttcttaacctatttgtaagtcaagcaaattttaaaaatccttcttaagggaagcttgattaatgatttcttctcattttcaaatgtagttaaacatttttaaacacttaaagcttgatttgtaaatttaatacatttaattttaagtactttagcttgtctaacttaacaaatgagatactcatgaatatttgaatagctcatcaattagatacttataaatatgaaatatagtttttaagttcttttaaagttctcaatgtacttgtaaacttgtaaggatttcaggtcaaaacgataagtttaaatcatttactcgatttaacattttaaattggaagcacaattctaattcactattattttaataggccaaaatatcttaaaattacaagtatataaaatatcagggccaggcacagtggctcatgcctgtaatctcagtgcttttggaggtgaagccaggagaatcactcaaagccaggagtttgagcccagcctgagcaacacaggaggaccctgtctctacaaaaaatacagaaattagccagaggtggtggcatgcacctgtagtcctagctatttgggaggctaaggcagaaggataccttgagcccaggagtttggggctgcagtgagctgtgatcacaccactgctctccagcttgggtgatacatcaaaactctgtgtctataaagataataaaataaaaatatgactaatgcaaaattatttgatactatgggtttcatttcatacagtcatatgaaatgaaataattatgtatacaattatatatatatacatatatatagagagagggtgtaaatatataatttattcttaatgctcaatcttatcagagctgaaagatggttacccatgaaggaatcaatgacaccatttcacatatgattgcagttaccattcccttgtagttgctgggctagctctctcagctttccgagatttttttgaggctcagaggacctcctctcctgaatgagaactgggttctaacgaatgaccctaactgtgccctgttacagtggctctgtcttatgcccacgtgaagtgatgtcacagaccatattcacgatatcgaagctacacattactaaaccttctgccgacccacagaagcccaaaactcccatcctcatagtcatatcaatggattagattttattatatttgctgcaaactctttttataatgttcttcctactcaccttattcttatgtctattctattgagatctaattaaattatgaatgtctcttaagactctatctggctttatagtgacaacatcaaaggatatttgtattagttagggttctgcagagacacaggatgtgtgtgtgtgtgtgtgtgcatgcatttgtgtgtgtgtacacaagtcccaagatgtacaggttatgttggcaagccaggagaaccaatggtgtagttcccgtatgaaagccagcaggctccatacccaggaagagctgacatttcagttccagtccaaagtcaggaaaaagccaatgtcccagtttgaatacaatcaggaaggagaagttctttcttattcaggggaaggtcgccattttgttctcttcgtgtcttcaactgactagatgagatccagttacatgaggtagggcaatctgttttagtcaatttatatttaaatgttaatctaatctaaagccaccctcacagaaacaccagaataatgcttgaccaaatgttgggtctcctcataacatacaaagttagccatcacgatattttcctggcatacactgtgaaaccactgacctggaaccctctgacttctgtcagctatttaatagataagtctttctaatcttgagtgtttgtaaagcagttggatataaatttgaaaatttttaaatgaaacgataaatcatgtgtgacctcttgagcctattaatcctaaagtaaaaagtccttgtacaaatttttatccactttttttttttttttttttttttgagacagagtctcgctgtgttgcccatgctggagtgcagtggcaagatctcggctcactgcaacctccacctcctgggttcaagtgattcccctgcctcagccttcctctcaagtagctaggactacaggtgcacaccaccactcccggctaatttgttcgtatttttagtagaaatggggtttcaccatgttggccaggctggtcttgagctcctgacctcaagtgatctgctggcctctgcctcccatagtgctgagattattgctatccactcttgatactgtttggcatgtgacttaaaacaagcaacagttgaaaatataaactagaaaatgagcatatatgttcattgttgctaaaggcttggtaccagcaccagctacaggagtttatagcataccttctcagagaaaggcctcttcattctgggtttagaggtgttggtatcctctgttgcaagatgttattcaatcaattcaatcctgagttttcaacatcagcaacattacatgtgcatttacaggaagaagaccagagtaggaacactttcattttttcccccaaccatctacaaaaatgaagattacctgaaatgtttactttatactatgatcttaaaactatttattttaataatatctatataacccagatcaagaaaaccagtgaaaattagcctattcaatcctttcaaaaggcttttttattccaaaagattgaataaaattagttactccctttatcctgaatttcactacaaatattacatttgcaaatgtcccatctgactgtaataaatgccagtgactttaactctgtggttggtgatatgaagaaaaccatatgtgatagattctaaatatataaccacaaaagccaaactgacggtttggaacatctcagcaactattattgattactacagttgaagaggttgaatcagtttgcatggcaattctcctcctcttcttcctcccatacccactcctcctctttcttatttttctctcttgctctctctctctgttctccattcgttgtttctttctaattcgcagtagcagtagcagcaaccagaaaaatatttgagaactttaaactaaatggttaactaataaggcaataaatagaaggtgtgacactgaacgaggagtaaaagccaatgcattccactacattgagagacatttatgaagtatattgagttacacagacactaacattcagaaacaataaaatagagacagtgtaaaaggctaaaaatgggctgggctcggtggctcacgcctgtaatcccagcaccttgggaggccaaggcaggctgatcacgaggtcaggaatttgagaccagcctgaccaatatggtgaaaccccgtctctactaaaaatacaaaaattagccaggtgtggtggcacacgcctttaatcccagctactcaggaggctgaggcaggagaatcgcttgaacctgggaggcagagtttgcagtgagccaagatcatgccactgcactccagcctgggcaacagagtgagactacgtctaaaatataaaataaaataaaataaaataaagactaaaaatggcccccaaaagatatcaggttaaatccctggaacctgtgattgttccgttatatgataaaatatatgatttagttaaggatccccagaggaggagcttaatctaaattatgaatgtagtaaatgcaatcacatgggttcttctaagagagacagggggtgttttgagatagacacacagggaaggcaatgcaaaaatggagcagaaggggttatagctaaaaggaatgccaagggccaccagagctgtgagaggcaaggaacagatttttccctggagcctccggaggaagcaggccatgctgacacattgattttgtccttctggcccccagatctaagaatatatttctgttgtgttaagccagcaggtttgtagccatttagcagccacagaatactaatatggacaatgatttctgagaaaataaaaagattattttgagaaaataacaacattccttgtttgatttttaggaaaagccattttattttaatttttttctatttttttatttttattttttacattgaggttctctttattttttactatttcttttttcttttcttcttctttttttttttttttttttgagatggagtttcactctgtcgcccaggctggagagcaatggtgctatctcagctcactgcaacatctgcttcccgggttcaagcaatttcccacctcagcctcccaagcagctgggattacaggcaactgctatcatgcccagctaatttttgtatttttgtagaaatggagtttcaccatgttggccaggctggtcttgaactccttacctcaggttatcagcccacctgggcctcccaaactgcttggattacaggcatgagctacagtgcacagcctatttctgactatttcttgacggccatccatgctgggggaacaccctcatgtgcctgtcaagcccaaatcccactctaaaaattcagattcccttttctgactccgtaggatgcctgtccacggaggtctcataaatccccaagcccacattttccccaagtcctccccctgctggttacctttcctttcccactcacatggagcaggtgtccgaaacaatgggttttgggcagaaaacgcattttagtcaactgttgtataaatattctaaactagtaattaagattttaagcatgtgctctggctggtcatggtggtcagattgcaaacagttggcaatcttatttcagcagtagactagaatctggtcataatttatccaagggaaaaaagacttgtcattaaattctctccaacggtcctaaaattttaatttatccacgcctaccttgtccattactgttttaaaacagctttttaaacgtctagattccagccctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctcaaaacatatctcaaacactaaaaatattaacatccacaaactaacacctacttataaaaactctagcaattctgagagaaatggattatttacaatcctctctctgctgatgttactgttaaatgtcatattaactcccagttatactgaaaccattttaaatgttatagtactttgaccttggttgtgaaaataaagtgtctagtgtaattatttagggatagtatagttcctaattaagacaaaattttcagcaaagatgattaaaatttgataagcttttaaatttttgtgtaatttctccaaataatgaaatgatttctttttctaaaaaaatctataaatttccagactgaaatatgcatgtcagaataaaggaaaattttattatggatctgaagtttgctccattttataacacatctagaaaatttggggtactggcagagtgaacccacagaagagattctgatgaaactgaaagtggattggtaggaaaattgctttacaataatctctactacttgcttttcatgtaggggtttgggaattagtctcttatttctacaactttctatttaactgaaaagacctaacatcttataataggattacactttctggtagaattttcatgatacaattcatttaaactatgttctttgcatgttctgatgaagacatttcctatgatggcattttggtctttctatctccagggaagtcaagtgattggaaagaattttaaagagacttgggctgagtgcagtggctcacgcctgtaatcccagcactttgggaggcccaggcaggtggatcacgggtcaggagttagagaccagcctggccaacatggtagaacctcgtctttactaaagatacaaaaaattagccaggcagggtggcaggagaatactcaggaggccgaggcaggggaattgcttgaacccgggaggcggaggttgcagtgagccaagatcgcgccattgcactccagcctgggtgacagggcaagactaggtctcaaggaaaaaaaaaaaaaaaagagagagagagagacttgatggttttctcttgaaaaaataatctcttagccattttccactgccacgagtacatgtacattgaaattagtgatactgaatttatcattggcaagatatctaaataagatttactgtagattaccagcgcattaaggagctcctggacaaaacatgtgcacattttctggctgagaagtgcagtcattgaagatttgtagaccagaacataacatattgaaccccatatctatctatatgccagtgtgtgtacttacatattaatttctcctatgaaagaggaattaataggaaaagaaaagcaaggaagtaatgttcaaaacttccttaatggccaggtgcggtggctcacgcctgtaaccccagccctttggggggctgagaggggtggatcacctgaggtcaggagttcaagaccagctgaggtcaggagttccagaccatcctggccaaactagtgaaacctcgtctctactgaaaatacaaaaattagctaggcatggtgtcaggtgcctgtaatcccaactacttgggaggctggcacaggagaatcgcttaaacctggaaagtggaggttgcaatgagccaagatcctgtgccatggcactccagcctgggcgacaagagtgaaactttgtcccaaaaaaaaaaaaaaaaagcttccttaaaaacaaaaaaagcttatgttgccattatttgggctattgatttttttctagtgcaaaacatatacatatttgatatataaccttggaaaatacacaaaagacaataacaaaacactcaaagtcctgctatctaaaaataaacactttgcttctagagttacttttattcatatttttaaaacatatttataggccgggtgtggtggttcatgcctgtaatcccaacactttgggaggccaaggcgggtggatcacaaggtcaagagatcgaaaccatcctggccaacatgatgaaacccccactctactaaaaatacaaaaattagctgggcgtggtggcccgcacctgtagtcccaactactccggaagctgaggcaggagaatcgcttgaaaccaggaggcggaggttgcagtgagccaagatcgcgccactgcactccagcctggtgacagaatgagacgctgtctcaaagaaaaaaaaattatatttataattatagtgagtattccatttctgtgtcctgcctttttgtatttatctaaaatttaatttaaaaatttctagatttctctgtaaaatcctgggaaaatcaaggcaagttcatagtgatctatgagtaatctattgaaatagcttggcattacataaaagcaatcccttcaggtctgaataaaaccataaatagaattttccttttggcatttacttcattttagactcatttaaatagtaggtttatcaatgcagtttattctgagcagagggatgatgtaatgtataatcagttactcaagtcaaaatgccaggaaagtatatgaataggtagcaacaaggtattgggttgaaaagaaaatgcttggctggctcttagatggcttgccctttagttgctactttccttggaccctttccagggtctccaagcatgaaggacccatctctcaggaagaagtccttgcccagggctgtttatcttagttgagtacagccaagtacaaaccagagcgaagttgggtcttgatctcctattgggtgccactgtctctgctttcttttatggctaacaagcctatactaccacaagccacatttcatttgatagcatgggtagtggaagagagcatccaaagccagtcaatcctaaatcatgtctgcaaaaatatctgtaaggataaggcctggtggacctcaagaactgtctccctctagtaataatcatataacattattattttgcagtgaaaaattatccagtacacaagcagtctatgcaatgtaatgagaagaatgctttgcaactgtactactagaagcgaactaattcatgatttatttttaagtgattagaacccttagtttatctgtgagaacatcacttaaataaaatgttttaaaatatgcaatgcatatgcaatagcattaaagtattaaatagcatcttaaagagcaaaagaaactattaagaataattaagtggatttattggctaattggtgtttccacatgtagttatttctgcaattattattcatttgctgatttacatagagctattctctaaaattactctggcattaaatgaagttagaagacatctccagtttggaaaatctattaagcaaatccttttcaacttaaagttgaggtgatactgaatcaaggcctggcagaactgactacagactcagagggagtatgtttattgcttttaattcttcctatttctgtttgaactaacatggcaaaggctttcatcttccaaactacacttatccagtctataaaacaaagatgatattgtttcaactataaagcacagattaactttgggaggctgaggcaggcagatcaccagaggtcgggagttcgagactagcttgaccaacatggaggagccccgtctttactaaaaatacaaaataaccgtgtgtggcggtgaatgcctgtaatcctagctactcgaaaggctgaggcaggagaatcgcttgaacccaggaggcggaggttgcagtgagccgagactgcaccattgcactccatcctgggcaacaagagcgaaactcagtctcaaaaaaaaaaaaaaaagaaaagaaaagaaaaagatcgggtgcgggggctcacgcctgtaatcccagcactttgggaggccaaggcgggcggatcatgaggtcaagagatcaagaacatcctgaccaacattgtgaaaccccgtctctactaaaaacacaaaaattagctggggatggtggcatgtacctgtagtcccagctactcaggaggctgaggcaggagaattgcttgaaccagggagtcagaggttgcagtgagccaagatggtgccaatgcactccagcctggggacaaagttagactctatctcaaaaaaaaaaaaaaaaaaaaaaagaaagaaataaaaagcaaatactaccaaattcttacctaccagagttacgactgctataacccttaacatttaaacaagggaaatcatcatttgggaattgtatttcctcttcatacaaactagtcttccatggtaatagattggctggatgtttttccagtatgttttctagataaatagtccttggagccattgtttccctaagaattaccaaaaaaataaaaacagaaagcaaaaacatgtttgctttctgctggaacatacatctcaggcagtgccgaggactaaagataaatttgatacctatggaggaatacattctaaaaataagattttatatctgtttgcatgttaacaaaacttatttgtaaagacacacattctagaaagtaacctcaaaagtactcttataaagcacctcattttgaaagtcaagtagagcaattcctgggcagatgataatgatactgcagagacatgtgaagaaggaaaaaaaataataatttcgctccctgtgttagtctgttctcatgctgctaatgaagacatacccaagactgggcaatttataaagcaaaagagatttaatggactcacagttccacatggctggggaggcctcacaattatggtagaaagcaaaggaggcgcaaaggcacatcttacatagaggcagtcaagagggcatgtgcagaggaactgccctttatcaaaccaccagatctcgtgatacttattcactatcacgagaacaggatgggaaaaacccactgccatgattgaattcccttccactgggtccctcctgtgacacgtgtggattatgggagctggaattagagatgagatttgggtggggaaacagccaaaccatatcactccctaagactattacatttcagcagttagatgaagagagaaggacagggttcagattgaatcattttggatggaggagaacatataaataattgaacaataggagcaccacctagtttagagacaacctaccacaggcaaatacctcacatgacttcattgttctcccccacaccttctctaccatcagatttcacccagaaccctcatgtgccacagaacttcaagtaaataccagccctggaatactagtcagaaagctgaaaaaaacgtgcaatatgagtttgaacactctgagatcgttaacacttttttcaataaggttagataactaagatgataaataaaaatattttaaaacattaataaagaggaaatgattctcatagaattagtatagccaaattttatcttcttaattgttgtatttcatcaagagacatagataggattaattttggttttctactataactgcttccatcagggaaaatagattaatttctaaaataccaccagaatcttagagttgtttatccaagaatctctaaagacactttacattgcagagtaagtcaataacatgggcaaatataaagctagggaacatgtgaaaaataaaattatgagttacaaacattaaacattatttcagtagaaacagattggtggctgcagttgattattaaagaatgccattaagttgtcaggaataactgttgtagttttctgaaaatagtcattttgttgtagctttagattggattagctagagctatacacacgagagatgcacatcaggccttagacacaaattccttcaggaaaatgattcactggctatttagggggttgacagccagtatatgttgttttcgagtcacagagaaaattgtatggttgtatattctgctttaatttacatcaatggaagatgagctacaaagcagctattgatacaaaaggcaaacccattgtagaaaatgaacattttctgtaagctacatctacattcttcctgatcagaaaataatacagaaagtgacatacttgttcctttttcacatttgaagaaaatgttacaaatgcctccatgatgcaattctgtatttagacaatctaagcattgagtcttgggatacttattctgtaactattttctaagaataacctgaatagaaaacatggaatttggtagtaaaagatataaataatgaaaataggggtagggtcctgtgcctcagtgaagtttaaaatttaattgaacttctaaataaatgtttaaaaatagagcagtttcaaaaatacaaaagctagaatattcatagacccctgaagatacttctacagtatcccacagttccacaatctctgattcaggaaattacattaaaagttatatgttggcattttggaatttcatttggtatacatacctgcagacagaggcaataaaatcacatcaatggtcggttacaaatgaagtcatccagttgacccagggtatgctttggctaaattttgttttagatttgccctaaaatataattgcaatattgaatatctctaatagatctcaagggccctctattagtccattttcgtgctgctgataaagacatacccaagactggacaatttacaaaagaaagaggtttattggagttacagttccacacggctggggaggcctcacaatcatggtgaaagtcaaggaggagcaaatcacatcttaggtggatggcagcaggcaaaaagagagcttgtgcagagaaacctccattttgaaaaccatcagatctcgtgagactcattcgctatcatgagaacagtgcaggaaagaccggcctgcataattccatcagctcccacgggttcctcccacaacacgtaagaactgtggagttacacttcaacatgagatttgggtggggacacagccaaaccatatcaggcccactttgcaaaatatcaaaacagaggggaaaagtataagtaactgaagagaagggtgcggtgtgctgaatacaaagatgctgactggggggagtgaatgtacctgcatcccaatttgcctgggaggtctggttttacccattgtctgacattctgtctaatttagcatttgtcctgaatatttcatttagtgatgtattattgttattagttgcattaaaacaagccaagatggattaggtagacctccacgttgtacttccagtttcgtcatgttatggtcttgggggtgcaggaattcccaggtttccttgaggtgaaatctgaaagctgagaaatatagcacagctcacaaggaagaagtggataaaacagtgtcctcagagcagccagggaatcctaacccctgacgatcttcagtgaggcatttggtactccaacctgttgtgccttagccctgagccccagtctgtgaggtgcatatggtcctagctaataggtcagtgggaaaagggagaaataataaacgaggctgtgtgtaaacttacgtgtaggaaacaggttaagctgttctgccctgttgcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggcatgcagagagtagtctgaatgctattgccacagtggttttatttttattgtgtgatgtaaccatatgccaatttttttctttgactattgactcactattttataatgcatccttctggcaataatgaaataaaaattagtaaacagaagtaactgtttaatgaaaatgaagtatttgtatttctatttatcaagaaagaaaagacgaacctgtggccgagcacgggggctcacgcctgtaatcctagcactttcggaggccgaggagggcggatcacctgaggtcaggagttcgagaccagcctggccaacgtggtaaagccctgtctctgctaaaaatacaaaaattagccgggcgtggtggctgatgcctgtaatcccagctactcagaaggctgaggcaggagaatcacttgaacccgggaggcagaacttgcagtgagccagattgcaccattgcactccagcttggggcagaaagaagagaaactcagtctccaaaaaaaaaaaaaaaaaaaaaaagagaaaagaaagaaaagaaaagatgaacatgtaacttacacaaaacacttgttgccatttaccatggggatataatgaactaacattcagaagtcacacatatgctgaagaagcatcaggatctacttcaaaagttaaaaacattaaaaaaaaacacagaaaaaaagagtgcatcttaaaatgacttaacacacacaactgcagaaggtggagctacagaacatgcttggaagcacgactttttatttagatcagatgattgttctttgacattaagttagctcattggcaatttcatgatttcttgtgcatatcccaaaatgaaatgacacctgttaaagtgccagcaccgttagcaaaagaacatttaaaacagaaagtggtgccagttttatttcaatgtcatcagatgttccaaacagaaaatcactccagttaattcttgtaatggtttcgttttctcatccaattccgaggaagaaactaaagctttttgaaattaattctgttgaatgtattattcatactattttaaattcagttaatatttagcctacatttctagcatttgtctaatattaacacagtttttggtggagtactgcatcatgaagaaacctaacactctgaaatttaaagatacgaaatttacttggaaatagtttttatgtacatataattcatacttacatccaaataaatgttgatagtctctcaattaaaataaaagctgtaagtttcaaatttttgaaataggtacatatacaattggatcatctgaactgtgaaattttgttaggaaggtaatgttgactacaaaaaaaactcagaatatcaggattcactttttctctctgctgcctttcttcggttggattttagaaacgttcatgagtgtttaatcttctgtgcttttaaaattcttctgagtgtcttaaaatagtactgaagttttcatgacagtcttttcatttttggctgaatattgttttaaaatcatctagaaatctttcatcaaagtaccagtgaatggaacagcaaaagctaaagatttcaaagcttttatcaaaatgcgattttcgcaaacaaattatgaaaataggaaggcatggatatgtatctgcaaaggcaagggagaaactaaagaattgtagaataaagctcaaatattataaaatatgtaatttgaaaactccaattgtgttttgaaatattcagtttgtgggaataatagtttgatgaagtttcaatttttaattaaataaatttatatagagcagatataatgaaattgaagacttagtaaaactttcaaaaaaatcctaaagacagtttatttgatgatttttgacttttaaatatttgttaatgaaaagtattcttagtaaaaaaaatataaaatatttgggctgaaatatttaatataaataattgaattgaaaatattttctgtttagcacaagctctgagcttgttaagtaccttgtgcctgtgggagaagctagtctttaaaagtttaaatattggccaggtgtggttgtctcacacctgtaatcccaggcgtgattaatttgggaggctgaagcaggcagatcacttaaggacaggagttcaagaccagcctggccaacaggagaaaccccgtctctactaaaaatacaaaaattagctggtcatggtagcccacacctgtaatcctagctactagagaggctgagaatctcttgaacccaggaggcggaggttacagtgagccaagaacatgccactgcactccagcctgggcgacagagagagactctgtctccaataaatacataaaaataaaaataaaaatttaaatattattgattaaagataagaatgaattagttttgtcactaatttcatacatattaaccatatcatgccactttgaagaagattgtaggtaatttatgaaaaatgttcaaataagactgtatttttttaaatacttttcttagaaaaatactagtgatatactattaaagacagataaaactttaaaaaattgattaaagtacttgcattctacttattttaatgttcagattgattttatgaagaatttttgcgttagtgaatgaagctttgtgttattttatattttagaaataattctagcatagcatagaatattttataggtatacgaatataataaaaccagaatgttgttcaccagacgaattcttcaaaaaaaaatacaatcttcacttttagtctactttcttactctcaaaagtatcctaattagtctagtgctgaagagtttcaaactcatttaaagagaagtagacaaataagtgacaggaaggattgccgtgtgtatcttccagtctggggtgatgtttaaattcctcagagtccacttagctttgtctcttcaccagccttggtttgccccagtgctgttcatcattttaacaaaaatagatctcacaggatgttcacccagtcacctttttgtagggacaagctttatagtcctagcacttgctgattctttaaatactgtgctttggtccaggggatgttaccttaagcccattttttgtagttagtaaataagacttcttcccaaagtcacgtgcatgttcaagttcttgcattgccagtgtgtaatggataaagacaaatgtatagtaaaaaaatcatgaggcagtctttggttctcatcccagccctgttggctgtgtgatatttggcaaattattttacttctctgagcctcttttctttccattgtaaaatacagagaatgatagttaagagtatttttgtggaaatgaaccaacacaatgcagctcaagtatcttagcagagtgcctgtgttcaataaatattaataaaatgacccttaactcccctcagcaagtttaaaaacaggaagtttccatttcaccatttactttccaattctttgttaaagatggccataataagtaatgagagtgtgcatttgtaaatgtctgtcaccaatgtgaatttacttgagatgactcaaaccacattctatactggaaaaggtgcatttaacgggcaaaagaaaagcccaggccagtttctttctgtatcaaccctgggtaaatctccttaagaaaaaattaacaatcatgatttattcatagggaaagaatttaactacttgttagcattcgaatgggtcctaaggaaactcccaagttaattaaatcagaactttcttcttgagtttgatccattatagtgagttaccagctgggtatcaactgctttcccagaaaggccccattgaaattaatggactcagggctttgttgagtctggacactagagaattggacaaatgacactgtggtttattaaagaattatgactgcaaatacattatatgatgctttctccctctctctccatttaattatgaatctgcctctcaaaagccttgactctgtattttaaagttgacataaatggtaggacgaggttactttttccagtaatggagaaaggaggagaaaggttgctccgaattttgtgatcttgttcattttccgatgaagtttttttgctggtccaaatattaattaatcgattgattgaaaatgctacaaaagaggagccattcatcaaagaaccaaatccagtgattcgtgatctggggttttatcacttatatttctagagcatccttttgcttttacaacttaaatttaattgaaattttaatccctagcaggtttttaataatgggcagcttttgagacattaaaaaacattgctctcacttcccagataaggaggttgtccagatatccttatgctttagggagcatttactaagtgatggtacttcccagcgcacatttttggttttgttaaagtatcttaaaccgcccatgtgtagtcaacttccccttatggaatccattgataaatcatggcaaaaggaaaccactctatggaaataacgtctaaaggagaccctctttatcccggagaggaaaaccagagagcagtcacaatctggctaacataaaaagaaccactccttgatgcaaatcaaaagactagatgtagctaattagacatgggaaaagggtggttctcctgaaaatctggggcctcaggcattttctggaatgtgtacagtcagaacgtgcaagttagtcagcaaagagaaaacaagcagccacacctctcccaaataccgaatagtcatccttcttttgtggttcagaggtgtttgtttgtcttagaatgctgcaacttaaaaccaattgattttaaataaaaatggtaacattataaagtgtgaaagtgtggggttaggaatcatttcccaccctgtgaaaatggctctatggtcacccaggggtttgtgtgtgtgtgtgtgtgtgtgtgtgtgtgtgtgtgtgtttgtgtgtttaacctgtgagataagaatggtcaaccagttgactcctcaagaacagtctagattgctacaggcatgaagttgctttgagagcaggttgaatgcccacacatgtaggtttggtagaggtggtggtgaaagcggtgagcatggctgcagggtactcatgccactcactcctttttgttacctctcacaacctctctctgtctccatctgacatgcctccctagactgtctctaataccattagaaacttcagcgcaaattgtgcaacctctccgacactgaccacaaaccctttccagcctcagaaatgttcatagatagatgagggttatcagggttgctcagccagtgaactccgaccacgctgggtgaggctacatttgtaatctgttctggaaaacgggaaccatgctccattttcaacctgcactcacccactcctatttctttctagggtgtctctgtttttttgcttttaaccttgggtttgactttttccagtggacatttctaactaggaaacttgatggtttccacttagattcccttattctccaacttaataaacatcaatacatttagaatccttcgctttccaagactctaactgatttgtggccacagtgatctttaaaattcattagactttcgtcattccattttctttattaaggcatccatatgagctgccatgtgtttgctctctttcatatatctgaatttactgattgttgtctccaaaacatgttctatcttagacactatctcatcctcttctctgccagatattgattattcatacattctctgatcccaaccaccagctttactcattgttatgtctttgtagctttttcttcccttaaatacaaggacaacctattatttccacaattcagcactttttactgggtcttttacctctctaaacccaacaagagcatcaaagcatgatgttgggcttggtgcctctcttccaccattctttctctttttaactccacatgtgtgctggactcttgcttatgatcttccctgtgtagctaccaccacaaaaatgtgtccccggcctttacaaatgaagtgttcagatgcaagccattctcttatagacatggcagtaaagaccaattaaaaaagggggaaaattggtgctacaatgtcactttgcgggagaatgatgtctgtaaagtgggagcctatgtcttgcaatatgctgatgccctggttgaatagaccaaactattcattccttcctctatggcctggggagatctctctccatcacacctcagtgaagacagctttgatgcatttgactgtggtgccttgggcctcccagttttcaatttttatttgtttttttctggtggctgccttcttgactgctgatgtgtagcttatgaaggagtgaaggatgtgccatcccaaaatatggcagattggtatattgagtatttcaagttgaaaacattggagacagtgtagtttcagaaaaggaagtctgacctgtctcttcctgcatgtagcacaccataaagattcctctgggaggggtacccttgccttaccagggcgagaaaatagcccttaattaccagagacttggaactggaggctacactggacctgatatatacacttaacaaagtaacgcttatgtgcctgtggttttacacccccccaccccaaatatctcctagtgactcccctagaaaatgtactgccctggccagattttctttttgctgtcatttcttctcaaatgtattatcattcattgtctaaaaaatataaaagccccttcttcagacttcactgtcttgtgaagatcttcatgtacacgtgaaattaatcaaatgtgtatacttttctcttgttaatctgcctggtgtcgatttggtttctaggtcctgctgaggagcccactaagagctaaaaggaggattgggggtgatcactggctctcctacagttatgccctattgttttttttctttaaataccttttccaacaactcgaagctcagcagtatggtggacttcctcccttgtgcatagatattgttgcatcatttctgtcttccagagaactacacttgctaagttcagaatactttatcagcttactttgtgtccttgttcccatggtggtgacaccgatcttgaagcttaaaaaatcccccaaattccgcctcccacctctgtgacactcttttgcaaaaatatgcaatttttctacacacatttctgacaaaaaggaaaaaaatgttaagtccaccctagttctgtccagacaagcacagagagaggcgtgttagatttccagacaaatattttcgcctagattttgctcaatgaacttgattcactgcagggctttttttcccacaagcgcgtggcagaggtgggctgccacaggagtggccagtgcccgctctctgcagggcactgctatgaatcaccattttcatgaatggaaagaataggaggaggggaaaaaggacaagcagcttgttgctaatgccctcaaacaaggcaaacattttgtgaataatttttagataatatatgacggtttggatctttggttttgttgttttgaatggaatgcatagaaaaaagaacttgtttcaacaaaagtttgatctgatatcctattcatgggctgattctttctcaaatatttggcagctcatccagggcacagaaaaggcacagtgttgaatcatgttgctttcaagctctgtatcagtggaaggcactggaagggattatcgatcccacaaaatacacaaggaaagtatgtgcccacttcatttctgaggaaatttagggttcagatggaccttgccatagactcagtgtctttagtagaggccaaataaataaataagccaacatagatgccaggcaacttaccatacagcatgctgaatttcttccctcatgtctggtgactggttttatagaacccattcagtgagaatgcaggagaagtctaagaattagaaggaacaaagaaaagagaatgagcacgggaataaaagtaaataataatcatgtctattcttgattctggggactggctaacttctgtcactttaaaccacttcacctcatttgaaagtccaggcttctcagcttgatgtccaaggttctccatgacacatatcttcttgagcacttcacttcatgccccgaccaagcttggacttcttccccctcacatgcttgctgtttcatgtttcatgttttagctcatgctgttccctctacctggaacatcttggttcactcaactaattctacccatcagaatttagcacaggtgtcctcctctcttcatggtcttcctaaatacctcttgggttcattattcctcttccatgttcatagatcaccctgggtattactctgtgctagcactttccttctttctgctatgtagtaccagtcaggcactcaggggaaacgactatgccattcactcattcagtcattcattcattcattcaacaaagacgtattggattactattatgttccaggcactgttttagggactgaagataaggtggtgaacaagacagataagattcctgttgtacaggagtatgcattctggcagggggatagattaaaagggaaatcaataagctaacacgttaagtgctaccgataagatgaaaatatgtcaatgggaagaagagtgcctgctgatttagactgggtggtcaggcaaagctttgccaaagagatggctgaagctgagagttcaaatgcaagaaggagtctatgaggatctgggcacggagtgtctgagttggaggaaatgcaagcacaaggccctagaggaagaatgagaactgtgagctcaaaaacctagaataagccatgtgactagtgaacagcatgtcccagcaaaagtcacacttagaaaatatagggcctgagggtcacaggaaaagttgtttattctttacctgatgggaaaccttgggacaattctaagcagggagttggaagacgtgatttatattttgcagaaatcaccaaggctctgcatgctgaatagattttttctttgcatccccagaacctagcacaatgcctgcctctgtttcagtagggcccagagccgtgctgcttttccacacaggaaaattgccttttccaaggtgcatggctgcccagtagagaggaaagctcaaagtcatatcaattcaacacgcagtactaagtctctcctcttgctccattttctactggcctgtgaccaactacttcctaaagttgaaattgcttccgatttcttttttctctatttcatggataatccatgcagtgtttgctcaacctgtttacactgagatgtgttgaggaactgtcccacggcaagaccacaaggtggggcagtaatgagtaattggaagaaaactgcggtaccttctaaagctcaaatgtggctttctagaacacgatgaagtggagccctacattcattatttgaccttgtttgtttttttttttttttttttttttgagacagaggagtctcactgtctcccagactggagtgcaatggcatgatctcggctcactgcatcctccgcctcctgggctcaagcgattctccagcctcagcctcctgagtagctgggactacaggcgcaagccaccatgcccagctaattttttttttttttttttttttttagtagagacgggatttcactatgttggccaggatggtctgaaactccggacctcaagtgctccacctgcctcggcctcccaaagtgctgggattacaggcatgagccaccatgcctagccctgtgactttttctcaagggcttcaaacagtccctctgcaagttaacctaggcatactcacagagcaagaaggcattcatgataccacaagggaggtgaggtttgtgccatttgctccatgtcactgaggcaggacagccctgtgtggctccattcccacgagagaccgtcttgctccgttaggactgcctcccacctgctaagggtgcttttcttccatggtacagtgatctttaatcatttgtttcaaaaatgtaccaacctcccgggaatgaaactaaccaaacttccctccctccctctctccttcccttccttccttccttccttccttccatccttcctgtttgccttccttccttccttttggattatgttgtttcattaaaatatatttagctgggcatagtggctcacacctgtaatcccagcactctgggaggcagaggtgggcagttcacttaaggtcaggagtttaagaccagcctggccaccatggtgaaaccctgtctctactaaaaatacaaaattagccgcgtgtggtggtggacgcctgtaatcccagctactcgggaggctgaggcaggagaattgcttgaacccaaaaaaagcagaggtttcagtgagctgagatcgtaccactgcactccagcctgggcaacagagtgagattccgtcatatatatattcacatgatttaggaaattctgtatttcagcatcacagtataaagacttaagttctaagagttgatattgctgtagatgttgggaatggaatcttaggagtaacctttaccggaggcaacttctactgcccttgctacctttggtgtgacctgaaaccccctttcttcattagtaccaagtgacttgtttgccactactcagctgtcccagaatagcttgactccacacatccatgcatttctaggaagaaattaggtgcattataaataacgagtcctctgaaaatgccgaagtgtcttaatcttttgaaaaaaattatctcaaatttacattcacaaggagccatgtcttttgccactaactgaaactcagtaacaacactgaagtatgagcttgggccttgtctgacaataaaaaggaaatgctaggtcccagggaccacttcaagatgtgcttgttcctttaaagcagggagttgtcacatccaatttttaacacatatgtatattttaacacatatgcatattttaacacacatatatatttctgattatactgtaaaactggtaaattatttttaaaacatcataaggcccccaaatcccagagaaagttgtttctattacaattttagtctatttgtctcttttaagtttctcttccctctgagcatatgtatctctaatgcatgtctgcttatgtaggcatatttatacatacaccctttcttttacaaaactgatatcaatttttgtattttaaataaaatacaaatgttttacattctttctaaacaagcagacactacttttggcacctcccaatgctggccaggtcatgttaactacccttaatcagctttttttcttgcaatatttgtaatatgcatcatctcagggcaagagacaaattagatcatttgaagattaataaatccttacctctgtttggttgcacttagccagcaaattcatcacatgcttagtctttgctttattctgggccatgtagactagctgttaagtggaaaaaaaaaaaattcttcttcggggcagagtggcaggatggctctttggaaagagtcttggagcaggagtcaaatggtctggctttacaccccagctatgcttacaaaagctgggtaacttgcagttcccttaccactaaagtggaaacatggatgtctaaagcttttttacagctagaaaagtctatgcttggttagcattgtgctgatgcaattctgttccagataaccgagggagggaatggcggtcctcgcgtgaagactaagtagacgtgctattaccctcctcggttggctccagcaataagcctaatgacctctacaaagctgttctgtaatacagaagtaaacacttactctgcacaatttctccttgcatgtgcttcccactggtagaacattattcatcttgttggtctttccaaagagattcattacttccttgctccttcttattcatccttcataatagaaatgctaaaagtctgaaagacgaggaagggagcacatttcctccctgcagtctgaggaatggctgtatctcttcatgagcaccaagaggaagcccccagatgggtccctgtccttacagccttgtttccatgtgcatttccaccccagcctcttccataatcgctccccatctctatgccccagcgatgccagttgttccatcaaacactgtcctctctgttctcagcctcggagcttctgctccctctgttaggggtgactgattctcaccaccaccaggctaattctgactgttctggtttcaccgcggatgtcacctcctccaagaagctcttctcgactttctgcctgcagaccctcatctaagctttcacaacaccctgtgttctgtgtttacacccacccaactttttcttttttaaattttattttaagttctgggatacatgtgcaggacgtgcaggtttgttacataggtaaacgtgtgccatggtgttttgctgcccctatcaacccttcacctagatattaagccccacacgcattagctgtttgtcatagtgctctccctctgcccacccccctgacaggtcctggtgtgtgttgttcccctccctgtgtccatgtgttctcattgttcagctcccacttatgagtgagaacatgctgagtttggttttctgttccttatgttagtttgctgaggatggtggcttccagcttcatccatgcaaagcactggatatcattcctttttatggctacatagtattctatggtatatatgtaccacattgtctatccagtctatcattaatgggcatttgggttggttccatgtctttgctattgtgaatagtgctgcaataaacatatgcacactcaccgaactttgcttcactgtctatcagaaaactgccagtttttcagttgcatttatctcctagaatataaaggctttgaatagatccaatggtcttgtttaccattgaatctgatacctaacatggaatctgacacctgctagacaccctcagaatgtctgtgaaatgatgtaactctacgtgatgtgtgtctactcatagctgtaaaatgagtgagccctcctgtaggtcacagtgtccagcagactggcagggacctgatatgaacatcacagaggaaaaaaacacatacgaaacaattaatgcttgccattgggccaaatgctttgtatgtgttatttcatttatatttttatttaatactaagcagacttcatgtaccctgtattttgctaggcagtggagtacatagaaaggaacagaaactgcgtatcttgtcttcccaactgaaaggagacgattaacctacttgaagatgttagaatacaaatacatgatatctgaggacagggtgaagaaaaacaaacaaataagaacatgaaaaactgtgtttgtcttgactattcaggatatgaaagtgccgcaacattcatgtatctagaaactccatgaaggaatctacacttagggcttaaagaatcctaagggaccgggcgcggtggctcacgcctgtaatcccaacacattgggaggccgaggtgggcagatcaggaagtccagagatcaagaccattctggccaacatggtgaaaccccatctctactaaaaatacaaaaattagctgggcttggtggcgcatgcctgtagtcccagctactcgggaggctgaggcaggagaatcgcttgaacctgggaggcggagggtgcagtgagccaagatcgtgccactgcactccagactggtgacagagggagactccatcaaaaaaaaaaaaaaaaaaagaatcctaaggattcctggttcctgacaggtgcttgttccttgaagtatacttgtgccgggaagcaaatcttctctctctcgttttgaacttggaggagacagcagctcccttctccttttcatacaggttattgtttataagagcaatgtgatgaaagcttcctctgctaagactgcaactccagcgttaccttttctttacctcaccttgatcctcggtgtgaaacttcactcattactgatgcattgcaattaacagatctcctctttcaagacacattagggtatgttctgactatcagctccaaaaaaataaaataaaataaaataaaataaaacacattaggaaatttaaatgaattagtgtaatcagctgagatagtacttgaaagggaccgtgtaggcttgtggtggaataggtactttcagacagaagtctctagaatattcctgaggaagtattttctcctgcccttcaatgaatagagtggtaaggtttgtgaaaagcaggcctctggcctgagttagggaaattatatattgtttgtccaaagtagtaaactctgtctaaaatgaaactctagactagatattattttttgatgttagatgtatacgttctctccatgatttagcagactttccagggaatgatgagtctcccctctactgaatactataaacatgttatctcagtgggaaaaatagaaagagatccagagaagaagagggaacatcttgcttttgaagcatctctgcttacgagtccataggaaataaattacatttcccagggttctgatttggtttttaataacttactggccctgctaaacaagacactcaggagaaagtgcatgtgaatagatggagatctacatttttagaaaatatgtttctttcttttgggatcacaatcagaacataggcatcattgaaacaaagccgaggaagaagaattttctcatgctatgcagaagttttctgttaaagatatcagaggctttgcaccctgagagctgtaatcttctctccttgagttcttcattgagatttactgcagaggcctcagatgtgtttatttctattatccagttgctcctaatattacttgcaattgttttggcatgagggttagaaattgcaagaactcctagctcgaaatcacagaacgtacacaaagacaaaacagaaataaagcagaacaaatgcaaggataaaatagataaaaatatctccccaccctaattgtgctcttttaaaggaatgctattgaaatgacaaatgaaggagatttctacctgttgttatatagctgggcagagtgacatttttggctgtattctagtgttgagcagttgcaaagctttctttccccctgaagcagtagagggtgctatgtggatataattgaagagatgctaagtttctatatgacgccagggcttagggactgccctctcttttcaagccacttgcttttcccaaaataactaagaaaagggagaaaaaaaatgagtacagaggccatgctagaagacatagataaaatattaagtcttaagaaaggtaggaaataatcagattctaaagttctcacaaggtttggtattttgaagtatttggcagaaggcaagggtatggaaaactttaagaaattgtaagcttaggactttatcgtaagcttaagacagagatgttatctgtctgaaaacagagggaaaattttgaacagagtgattcttgtaataagagaagacttttgacaagttatgaattccttgaatttcattattttttcttgctgtttaagtagtatatattgtatatttgatgacagtcagattttactgatagagatttgaaatatattttgatagggctacctcatgctttttgtagaatcaaacattttagagctgttcagccccttggagccattaagtacaatcttaatgtttttgcataaggagacattggcaccaagaagttaagtgacttaacctgtaacaggctggtccaaacatccgagcctcaactagaaccagtgtccttacccctggtccaaagctctctgtcttttgctaccctgctttgagttacagcattttatatgctgacaatacataatcctaatacatttatatattgttttcacttacaaagcagtttatgtacatttttccacacttatgtaccaaaacgtcctttgaaaatatgttatttgttgatttactcaaagaagacttgcccagttttatgacaggctgagaagttaagtctcctgttgcaattccgtttgcaattcagtatccattacacctggtcaatcaagtttcttattaatcccacgttttccctgcctgtaaactcccttcttagtgaccgattttgctattttgtgtgagcacttgagtaaaattcaactgactcagagtagggaatcctggctggattaatgggattgtgtaacaccttcatcacttgaggcccagataggagtgactgtgcgatgtaaaaaaggcttgccaacaccactgatgtttgacgtgaaggtgaaaagttcagtggcccagagaagtgctttaagggttcttcttaaatctaacacctgaggaacaccttcagattatccagcagttgtgatcccctatgcagtgtctatttgtctagacttcttccccaacacacattccctagtacatttaaatggaaagaaaggtctgggaggttatttgcaggggtgttgatggaaacaggacccatcacagctagggtcatgttatcagagtgcagattttgaattcctttctgcctttcctgcatgactttaagtaagaaaatggtcaccttaaatttgcccaataagactcagcttggaaatcattcttgggatgcagaaggatctggtccagaaagcttcagagaagccttgagaactgcctattcaagaggagaagaaggctgagagagggaacctgcaaagatctagcaggaaaagagtcttctatgtgcaaacaacactagaccctttcccagaattggggcactaacaaaagataatgcctctgaaatattgggaaaattgttggagaatatgatctcgttccctatgctgtcactccaggtaacacccatgatgctcaaaggatttttttaaattaaaaggagtaccactttatttaacaggtagaaaattatggaaattattataccaagaaaggacataggctaataacataaattaggcttaaggagagtttcataaattatgtatctccaatggattaatgaaggaaattaggaataatttttatattatctctacttttttacttatatatttggacttgaggttttctgcatataatatgcacactaatataaatattaatataatgctaatacaaaggaatactctctcagagattgtgcattaatgtatgtttcagtgacaaaatatagtgcgtgaccttagccccaggaggaagaataggatatgtgaaagaacctaagattttgaacccaggataacctggttttaagcccaggtctgctacttaagagctgtacgactgtgagcaagttattttaaattgctggatcttgttttcctcatttacaaaatagaaacactgatatctgcatcatacatcatactattgttatgatttttaaattaaaaatatatgccaatgaacctagcaattggtgaccatattgtaggtacttcatggatatctgcctcttccttccatgtgcaaaaggaattctggcatcatcttttataattactaggaattttttactgccttcagaaaatatttctagacttatcctgctaatttttgtttagaagttagcctctgtttcagtccattctctcattgctataaagaactacctgagactgggtaatttatagagaaaagaggtttaattggctcgtggttctacaagttgtactagaagcatggctggaaaggcctcaggaagcttacaatcatggcagaaggtgaagaggaagaagagaagtctcaaatgactgaagcaagaggaagagagcaataggggaggtgctacacacttttaaacaaccagatctcaggagaactcactcactatcacaagaaaagcaaggggaaatctgcccccatggttcaatcacctcccacagggcccctcctccaacactggggattacaattcgacctgagatttgggtggggacacaaatccaaaccatacagtccctgaatatatatgtgcagaaatagactgctcacctagacttcaaaagacatgtcatcattacgcacctctgagacattgtatggtcttggttttaaatttcttgagtaatctggttaattctgatactagcgatcaacagctttggtgtaaaggtaggtcagattggtgatatattgctacagcaatttgaggaaatcaatttcctccctaaaagttttgacaatcttgtttatttatatattttatggtggtgaggggagaaattattcttgagatcttgcttctttgaaatatggttcttctcaggaatatcctatgttattagatgatctaaaacactgtggcacttcttaaataaccaatacttaagataccatgaaaattacaacccccgtgagatatagtatcaattaaactatgccatatacctcgattggttgagttccatccactagtcaatttcaaaattacctcgtaaatcactaagacaataggaaagaaagccttactataacttgccttactataacttgtcttactcccaaatttagcaatatctttttagcttattgatggtatttcaggaaaatcaaatgtagttccacattataaggatggagacatgtgttacctctttatgttcctgtatggcaaattagttgatactctttggtcttgtcgacatctctttaaccttgtaagattataaaggttagaatcatgtttaccacctgtaaaaaaaaaaaaaatctgacagcagtgggttttttttttttcttcttcttctttttctccaccacatcccctgataatgatttccatgggctggaaatactgggaggagagaaatatttagttgaattcattttaaatgaaaccaatagcttcactagtgatctcataacctcaaagcactttacaaactgagtaatcattgaagatgctaaatatagtaaatacaatgtttaaaaccttcacaaataaatccatattaaagtcttattctaccacaaagtagctttgcttttgatataccttttaaagtcatggatttcttgatggagatattgagttgggttgttcctgttgctttttgtttctttgatttttttttttctattatataagctagacctcactctcttagtcatttcattatatgtagagacaagatgctgccttaactagagctttattccaggtgcccaaaggtcttcatttagttcctagctcaattcgtgagtaaatatttcttttccagctttaaaattttttaaatgacattgtcaggcacggtggtgcatacctgtatccccagctacttgggaacctgagatgggaagatcacttgagcctggcggttccagtctgtagtgcacagtgatcatgcctgtgaatggccactgtactccagcctggacaacatagcaagaccccatctctaaaaaaaaagaaaaaaaaagaatgatagcatttcctttacttgtggagattttctgactataacatgcacactattattataaaataatagactttacaaaatataatggttgtagtttcatttgcactaaataacgataaaccttatttaagtgcaaccttattttatatatatatatatatatatacccattaatttgattgtttttaatgtagccatggacatggagagttcacaaattataatttataaatgtattaagatagaataattgcagaatagaaggatttttaaacaatttaaatagtcaccatttctgccacccattaatcctatatattggttctaggacttattcctggagttatatcctgcacattggcttcaggcatgaaggacttgatcccacatcttctccagtgggattgtggagatcgtgtcactgctggcctgtcctgcaggctcttgtggtgatcattataaaagccagccctggggtagctcaggacaggaaaggaaggatattctgaaatgattttctccttttagttaacacattttggttccagaacactgagcaaatcatcaactgaagccccatgatatattttcaaagagtgaatttctcttacctgactgaggcattttattctataatagcaattctctgggttttttttttttcatacttataacaaagcggattaatatatactcacctaagacaccaaagatactgatggctttcaccactctatctaagcaggagtaaacacctgggaactagaaatctgagaaagaggacaacacccaacaccacctaactatggccctcgatacagtcatttaacttaataaccttccgtgagagtaaggtcattatgaaatatgctcggttttacacaaagctttaaaaaaagccacataaaatagtatatgaggtcacctctgattcctatgtaaagaagattcctcctcccttccctcattcattgttctccacactctactccacacctcccctcaccctgcaatccaacttatcaaaagtttaattttccctttccaaaagcaatgtacttgaaattcctattcttagttatgtgcattttggtttcctctttgattttcctttttttccaggtttcctgttgataccaacatgaatctcaagggcttccctttgcttcttttggaaaaaaataaagaaaagagactgatttagagcctatagggtggaaaatcacagccaggaaaaggcaggcatagcatgcagcagttcagagacagggctcacccgcccatctcttccatcagccacctccctggtagggcatcccttggaacagaagccagcaatggtcctgcagggattggagaattgtgagctctaaatgataaaacgttgagtcataggttatcactgtacagagtgatcctttggcctctgccttgagggcacgtaagccattttttccttacttgttggaatttgattcatttcctctttttctcctttagctctctaatctagaattctcagtttatctataaaaggattcaatatctgggttgatcctgaggagtcaaagggttggttttgtgagcagatgggtggcagacaatagcttttgtagagatgcctctgaatgagcccacatggtggggctttgagaagcctagtgtggaatcagtaacaaagtccaccttggaataatagtaccatagtttcagtaactgctgattccaaaaatgtttcctatcacacatcttcctcatctgcctctcacaacaatcgtgtcaggagaaagctaatccaactataaagtggctacgtgatcagaaatgacaggatgggttcattgcaatgtcaagcctcagtagtttttcatcaaagccctcaaaaaaaaaaaaattccaccccaaactgattgtgtattattcaaccagacttctggtatcttcaggcacactgtttgcaaaggccaggcatctcttatgtcctgctgtctgtagacctctgtggtttatggatgggaaaactcaaacagtctgctcttagatggtccttattgcagaaagcaggcttatgccctgtaagccgggggtatctccaaatcgtgcaggaggagaggtactgattgctcatttgcttcttctgtgccttaaaatcaccatccttgttaaagaaatgcaagcattgagtagagaagtgtcttgcttgggcttgcttttgagtaccgggaattcagctttcctgctttggaaacctgagttgggatgtaggtgtgtagcaaaaggaatgggtggaggcttctaactaatggggaaggcatctctgaaacaagctgagatgtggatctgggattctgggaatcaaataattcttcccagcaccaaactttgatgagagaatactttaatgtctgtggttgcagaataaatatgattcactctgaggattctgcactgcaattgaatatgtcagaaaaggcaaataaaaaattggaaaatttatctgtaaatagttctcaatagttttagaagagcttccaaggacattaatttcttcctagccattatttattaaaaccttcaggatagcatctcattttttggccacactaatgtagcaactaagtgtgcaggccctggattcagagctaaatctgactctttcaagctgtaagcccttgagaaatctacataaatctctctgtgcctcattaatgtcaactgtaaagtgaggaataatgatattatgtattttgtaaggttgtccgaatgtttaaattagattataatacttaatattaattgaccactttggaagtgagcattgttctaaatgctttaagtatgaattttattgtcatcgccatccatatcaattatccttatttattatgctgttataagaagctttgatttcacaaagaaagaaattcaacacttaaggaggaggcatgagaaaacatcttattgaggtttttaatcatcttctagtgaaccaagcaagactgaacctttattgcaatgttttactaggctttatagcacttttaaagggtcaggtaaataaagtcataattcaaaacagctgttacggggtggggcacaatggcattgatatcaagagactctagtactgaatcagttacttcctatttatataattaaaaaatttttttgttgttgtttgtttgttttgagacagagacagctctgtcccccaggctgaagtgcagtggcacaaacgtggctcactgcagcctcaaactctcaggctcaggcctttcccacctcagccttctgagcagctgggactataggcatgtgctgctatgcctggttaattttttatattttgtagagatagggtttcaccatgttgaccaggctggtctgaaactcctgggcataagtgattctcctgcctcggcttcccaaagtgctgggaatataggcatgtgcccacacctggcctatttgtataattttgaataaatcatttaatcttgctgagcctcaaaaagcaagctttaaataaagaataaattaaaaattaaaaggttgaattaggtgatatcaaaggttcctttcacatctatgattctaaatattactcagtatttactctgtgcagaatgtctatttccacaggctattgcttacagcacaacacagtgatcatattcctctttcgtaactagggagctgagcaccacgatgctggctactggcagagtttatccctcagcccatattaagtctagaaatgattttgtccaactgatgttttctcttcacatcagatgtcacttttttttttttttttgatatggagtctctgtctgtcacctaggctgggtgcaatggcgtgatctaggctcactgcaacctccacctcctgggttcaagcgattctcctgcctcagcctcctgagtagctgcgattacaggcgcacgccaccatgcccagctaatttttgtatttttagtagagacagggtttcaccatgttggtcaggctggtcttgaactcctggccttgtgatctgccgaccttggtctcccaaagtgctgagattacaggtgtgagccactgtgcccaggcttttttttttttttttttttttgagacaaggtctcactctgtcacccaggctggagtgtagtggtgcaatcaaagctcactgcatcttcaacttcctgggctcaagccattctcccatctcagtctcccaagtatctgggactatatccagttatttaattttaaattcaccacactcagctaatttttgtattttttgtagagacatggtctcactatgttgcccaggctggtcttgaacttctagcctcaagcaatcaatctatctgccttggcctcccaaagttctgggactacaggcatgagccaccacgcgcagccagccatcacatttttagataaaacatcgaggaagtacttatactgatatatacattttactatagcaactatagtaaagagaaaccagtgagtcctaaaactgaatttttaaaaaaattagaaacatagagttaaaattaagattatactcaaagttcttcagagataagtattaaagtcatatttccaaacctttaggcactataaagaattccataaataagaggttatttaaaattaaaaaaacctatgctcaagcaatatctttgatcataagacaattctggcaatgagacaaattcttgaaatctcaacaacactaacatgggctcagatttttgctttcaataaatagaacctcatcaaagaggtcttggaaattctgctagtcaatggaataaaataatgaatcggatagaagtcctccagccctgtgctggaccgaaatgtctctgactgcctgtcatatttcagaggatcgtgctcctcagagcagtgtggggctggcacagagatgaaagaaagaagaggttcctccctggtttctgtttatttgaacctgaatcagaatagagaggaagcaaaggagaatgaatggtgtgatccaacttttcttccatatgtgaacaatattgacttatatggcataattatgcccagatgctgtcgtgacagggtgtagagatttctgacttgcataactgaatatattttttaaagacaacaaagaaaaagaaatcagtcacaacattgctttagcatcttgagtcttggagtgcttctgccatggaaagttatagtctctgctcttttctgcttagactgtatcttaaaactagcttcaatattggatggcctattttaagggagatcctgacacttagtatccaaattacaaaagatgactaggttactgaggatctgaagattgtcccatataagttatagttgaatcttctgtggaagtttaacttggataaaataagcagagaaatgacaaatgtgttcacatatgtgaagatcatccttgtttttcttgttttgttttgttgttttatattctaggaagcacagtggaatttgaaagacagactttagatcaccatattggagacctttataacaattaaaacataggaatggggcaggaagccttattaggtggtgagattgtgagattcctctgctgttgatggagactagacagaggccagatgaatgtgtcaataatgttgcaagcactgcttccatattggctagaaatttggaaggttagaaaaagtcaccaactctatcatcataagaaaactgagttgagggcagaaagtaatatgatatctgggttttggggaaaccagttacctctcttcaaatctttaatgtggaaagaatgaaaccatcttagacctttttgagtacagaatgacttgaagtcagaggaaggagcatggcagacacagaatgtcccaaattgagacagcatcttttaagcaaattgttgtccctttgggtagagtgggaataataatatcgcactcacatttatctcacagatgctgtgagggtgtgtgactcagtgtttttaaagagctttggatacctgctgtggttaatgtgtcactcactgcgaagctttccaaggcaattattttgatcagaatgtcactcagagttagtaggctggcttcatgaatcatttggggagggtagtataattcaaatttgttatgtattgtcaaacatttaaaaagaataatagtataaaacaaaatacttgcttttacactaaaatttaacatcttttttttttttttctgggaaaatagaatgttgcctaaactgaagtccaaacaactttactttttaccttttcaaatatccatgtggcatcaagccaggccatttaaaatgacatccagttatttaattttaaattcattttgtagaaatcccacctctctggggagtatgtacagcaaaagtaaggccatcacaaaagctgaatgtcccaaagtggtgctttttagcagaaaatgtaatttttttaagatgaaacttgccttcagtgttcttagagagtgggttccatattggtttctgaaggagagtcaagcctggtctccacagtgcactaaatgcagtagggggtcaagcaaatgatgggaaaagcataaatcatcttggaattatagattcctctttgctgtttgactttaaattcaccatctgctggctgaatcttgatgggagttgaacataaacataaggccagtgcatgactgtgacgtggaaggtggaagaaagttccttctgacttgttaaaacccttaaaatctacacattattattattataatttagacaatgtctcactctgtcacccagactggagtgcaggggcacgacctcagatcactgcagcctcaacctctccagctcaagcgatcctcccacctcagtttcaagtagctggcactatgggcatgcatcaccatgcctggctaattgtttctatttttttgtagaggtgggttttccctatgttgcccaggctggtcttgacttcgtgggctcaagagatcctcccacttcagcctcccaaagtgctgggattacaggtgtgagccactgcgcccagctgacatctacagattatcatctattattcttgtatttgttaaccatgatctcaaaatgatttaattataaaactcaaaccttaaaggacaattggattccaaaatgtagattatatgtagataatatttctgttcacaagtctaggtgtacattagtatccattcagaaaagtgaaaaaaagtttaaaagcatttttaaaaacatgatgaaactataacactcaaaataatgtgatgggggataaaaggcagttgattgataaatgagtcattgacaggtcaatgctgtaaaaggccgagtctaagttgatggctctcagtcctggttcgtcactgctgttgtggaacttggcaacgagtccctcttgggaattataggcttagcatcatgctcttgctcgtattagctgcttcttctatcactctttcaacagtaacatattaaaaacaaaaacaggaaaaaaaaccctcaaaacttctcaggtaagtagtattaaggacacaaaaatatttcaggcttgatttagaactacatttatgaaagtaaactacgtgatatagagcaaaaccacaacctttaggttttggggggttttggtcttatttctctttttaaaaataagagatagggggtctcattctgtcatccaggttggaatgcaatagcttgatcacagctcattgcagcctggaacccctgaccacaaagggatcctcccacctcagtctcctgaagctagaactacaggcatgtgcctccacacctagctaattaaaaaaaaaaaaaaaaaaaaaaaaaaaaaaaaaaaaaaaagtgtgtagggaaggggtcttgctgtgttgctaatgttgaactcctggccctaagtgatcctcctgccttacctgggattacaggcatgcaccttgtgtctcactaatagatttgctttctaggtctttcctgtcaggtccaccaatattttagatggatggagcacttgattagatcaggagtcaaaattctattcctgaatctattacttaccagttgtactactttgaatgaatggcttaattttttagtgactttgaattgttccagatataaaatgacaggataggtctagagagttgccttagatgaattaggaaacagtttctgagatagagatgttagtgcagtaggtttattggggagtgttctcaggaatgcctgtggggaagtgaaggatgtggaggaggaagatggactggaattcatttgccagagtcctcagcagatcctaccagctctagagctgggatggcccttcagagttatcctgatccacaaggggtcagcccctaggcattcataagtcactttgtccagtcattggggttgaccccaggaaaaggtatggtttggggtaagaggactcttcagttgagggtagttcctaggaagctagtgagctatgagttggcatcaggcaacatttccagcaatttggtcaatgagttccccttaaggctggatctgggccacggaccatggcactcactgccatattcacagcgtcgttttcagtgtgaaattctactgtgttaaagtattgtacagtcactgaaatgagagtatttttatatttggctacccatgacatttattctcttctgattatattgtttctctcctgatctagagttttagattgttttgtttgttttgttttgttttcctgtacttttctgtctgttgaggaaaaagagttttattcttctagtatgagagtttctattagtcctcctttttagacagatgaacaccctgtgacaattccttttgcctttttgtggcgtgtaaaaaaaaagaaatccataaatagagtcgttacgcaagtcttcatgagttaatttctctctccagttttcttactactttttccagttttcattttcttcaacagaaagcttcttcttctggctggacacagcggctcacgcctgtaatcccagcactttggaaggctgagggggatgtaatcccagcactttggaaggctgaactcctgagttcaggagttccagaccagcctgggcaacatggcgaaactcccaactctacaaaaaatacaaaaaaaaaaaaaaaaatagctgggtgtggtgatatgcccctgttgtcctagctaaaggggaggctaagctgggaggattgctagaggctgggatgttgaggctgcagtgagttgtgatcataccactgcactccagcctgggtgacagagggagatcttgtctcttaaaaaaacaaaagtttcttcaaattgcccctttacaatttaatatgcatgaacacatttctttacaaagagaaggttatcttttatctatattcaaaatcatatgccctggggatctttacatcacaatgcaaataaatgttgagttaaccaaaggaagtgtgagtaacaagttagtgactgggttagggggtggttaggacagtggcgtgtgattaagagatgaacatctcagaccgatgcttagtaaaacctacagggggaagcatgatgacctagccttgaatatctcatttaggaagttacacacgtgtctgggcttttcaaaatgtttgcatgccattaatcagcatcttacatcagcttgctcaatgaatgatgactatgtcaaatggaagtaaaacatataaggccagagaaggatgaagggaagttttttttaatgcagtaaaggataaagaaggatggaagtggccaggagtggtggctcatacatgtaaccccaacactttgggaggctgaagtgggaagatcacttgaacccaggagtttgagaccagcctgggcagcatagcaagaccccatctctgttttttaaaaataaaaaaatataaaaaaaagaaggttgtaagttattcaaacccataaggagttcagccaatgtattgaggtttcacactttagatatgatcaatttgctgtctttggccttaaaggaaaaacacaaacacagcagcctcgtgttcttctcagacattggtttctcctcctttcttcctaagacagctcttttcccactttctctctggccaagtccatgctcagcattgcgtgacttcactgttagtctaggtttattctgctctgggaagtttccctgacccccttcttgacagctgcagatcctgtcagtcacttctctgtgtgcttcccttgccttccttgtagatttttattacatcaattaggatacaccattacaatgcattattttgtataataaacacctgtatagtttctaccatatgccgggcactaatctaagtgatttacaaatgattattcttctgaccctcatcacaattctatgagagcagtctattattttcaccaatttatagaaaaggaaactgaagcatagagaattgaatacattttctttgatgtcatagcaagtaagaaaaaaggctaggattctaatccagggagtctggctccacaacaggtgcaattaaccaccagaccgtgaggcctctctgtcatatgcaagctcgtctgttttgctcagaagactgtgttttactcactcactcccaacttcttatggtaaaaattgctttttaatgatttaaataatacatgcccatgtaaaagttaaatcaatgactaaagcattctgaagaaaggaaaggttacctggaatcccatgaccctgaaataaccatcattaaaattttgttctttatccttccatgcattgtttaatgtaccacctacccacacccatacacagtaattaaatgggacaatataaccatttttttaaagaaggatggacatcatctgctctcatcctaccagagttgtctatcccaaaaagacaggttaaaaatctatgtgttttttctataccttttattctctcataggcttgtatctctcatttacgttaatggaactcattggtgtttcaaaaacatgatcatcttaaatgtactcttttagatgttgctttgctcactcagcagtcaccccatgtcacctggcaaagccctaatttatttttttcactggccacgtgacattcattccacagtgtagatgtatcacaatgcattcaggtattctcctatggtattaacttggcttctagaatgcaggggctgtctttaaccctggtgtttgtgacattgtgatgggcataatgggatcccttgaataaatatttgtaaaacatggatggaagtcagattttagaaagaataaattagttttttcttaattatgcatggatatggtcttgaatcggttctcaataaatcaaatttcagtaagggactcacttaaatgtatgagaagagacccctgtaatcaatgtttttaaagttaaatgattgtcttttacattttaactggtgtaaaataactaattattgttccaaatagaatttttgcttaaagatacgtacaatggaacgttataaaaccacctatatttacagataccttgtgctttgtgatctggcttgtatttttcctgttcctttcctgttaccctgtgtacgaaatgtatgttcttcccataaaaaaactaaactacttccagttgtgtaaacacaacagattctttcagaccactatgccttggtgtatgtcaaccctcagctaggaataacatttccatctctgtgattccattggcaatttctgctcaccttttcctaggttgaagtgccacttcttctgcaaaacttttcttgaatctcctttcctgttaccctcctgcacaattaaaaacttgcatccatttgatcccatagaatttatgctgtacttacatgacaggtacttacatcttttattttaactcatttatatcacttacaagactgtttttttctttaggacttggaatatgaccttttcatctttttcactgcagtctttttagtgtccagcatggagaaagtgctcaaaaatatttgttgagtgaatgacagtagagaaaataaaaatgtcctggattggaatcatgaaaactgtctacttatctctaatattaaaaagctcagtgtaatcttagaaaaaataatctgagagctctgacactttccagaggccacttccacgggaaaggaggagcaaagtctctgatcagaagttgagtaaatatcctctgaggtccctgattatccagacattgacaaaagaaaggctctccaaggtttgccattattactataaggaagtcccagctcagatgattcatagttaaatatttgcatctcctctggctaagaaaaataaaagccacgacattccagagcctttaggcatgtaagatcttggtactttcccagttattgctccttagaaaccggtaactgaaaaggccctgtttcagaaaagcaagatatgtcaaatgggaaggaagtagaatagctatctggttggaattcagaaagtatatcaaggccaacaatataattgttgaaattggttattaatgttttgatactgtgacatatctgttttctgttctctaccacaaacaagaaagatgttgaaatatggcaaatgttatgaataacaaagaggaaaatacaaataagttcttttggcaaatctccgtagcaggttgaactcagactcctttaatgtcaataaacaaggctcagagtcaatgccactttctttggtggtcactttaagtgtatttctcttacaacagccctgcacgtccagtgttattattactgcttcacagataagaaagtggaggctcagaaaaataatgatccataattgatatagtggtatatatataatttatatattataccataggatttaaactgaagtggtaaagcaggtggtaatttgcagagaatgattttggaaatgctccgtagatacctctggctctaggcatataaaactattttcttattaactgaaaatttacaattacaacttgattcttgtggtttaagacaatggaggctttctacatggtgcatgcgaattttcccaaaatctttcccaaattcatttataattcagtgtgggtgagcttaccagttcctttccagaaaacaattgtgattaaggagttcacacagacaattattctgttattctcctctgtcctcaggtaggcagtgctcctcgagctttgggtggcaatccttcaccaatccattgtcagtgtgggtccagcttttcctccttaggccacaaagatagagttgctcatattttatttccaaaatatagtgttaggggcctgaaggccacaaagaagactattctgaaagctcccacactgacatcctccccagtactggaaaacaagtaataaaagagtaggaaaaaagacctcagggccttgcacataataggccttccataagtttatttcataaatgagattctgcttgacggactggcagatggagcctgagtttatagtcctgtctgttattaccttgctttgggccctgtcataacacttcctctcaaacacgtttgaaagaaatgcagcccaacataggccgtctcctcgctgtgctgagagggtcttgggtctcacaaagcaacacacacagccaggtcatgtctctgagcatcggatctagaaaactacaaagccaggaagacatggacaatgctaacatcctccctttgtccaccacatacatgcatgaaaacacacctaccctcactctccacccacccacacacacacacactggaaattgtatcatacacacaccggaaattgtacccaaaggacgctattactaactatgaagcaagtggcacccatggcttgtccagagaagacacccacagggtcagacttcacacaacaagcctatgaatgggatagcccacatttaggagtggtcttctaatccagaatcttctctttatttagttcaagataacataaacttcctttttgtaaatttgtccatcatccactcccttgctcttatactctagtgagggggaggtcagatgataaatgacaaggaagatcatttccagccgtgatgagtgagatgcggaaaacagggcagccatggagcagcgagagaacaaccaggtgtggtcaggggattccctagtgaggtcgtttccaaaaccctcatgggtagacctgaggctgtgaggaaaagaggaatccaggcagagagaatcaaaaatgaaaagtcctcatggcaggaatgagcctatttcaaaaaaaattaaaaaacaaaaaaatctgggtggcttaatgaaaaagaacaaagagacccaagaggctagtcagtttcgactggtgcttagaggccatggtagagtggacatttttttgtttgtttgtttttgagacaaagtcttgctctgtcacccaggctgaagtgcagtggcacaatctgggctcactgcaacctccgcctcccaggttccagcgattctcctgctgcagcctcctgagtagttgcaattacaagtgcccgcagctaaacccagctagtttttgtattttcagtagagatggggtttcaccatgttggccaggctggtctcaaactcctgtgctcaggtgatccacccgcctcagcctcccaaagtgctgggattacaggcatgagccactgtgcccggcctagagtggacattttattctacatacaatgggaagccatttgagggatttcagcaaggagattacatgatctcaatggacttcttatttttctttaattttatactttaaaaatttttgaaacaggggctcaccctgtctcccaggttggagtacagtggtataatcatagcccactataatctcaaactcctgtgctcaaagctatcctcctgtctcagcctcccaagtagctgtgactacaggagtacacaccatgcccagctaatgttttaatttttttgtagagatggggtcttgctatgttgcccaagctggtcttgaactcctgagctcaaacagtcctcctgcctcagcttctcaaagtgctgggattacatacatgaatgcacctggcctgaatgtactttttaaagaatactaaggctattgaatgaccaggtggggtagcagagaggaacactgtgagtctgtggcagtgtctggataagggattatgtaagtaccactaagatggctatgttgaagagtgagggagcatttagtttgtctgttttataagtagaggccatcagacttcagaggaattcagacttaaaattcatgtgcctttgaatggggaccacatacatgtcacatcacactaacactaatgtttcattgattcattctatcccttcccaggaatcaaattttgattaagagaaagaccctaagtggctgaaggaacaaaaagagttattgcaaaaaaaaaaaaaaaaaaaaaaaaaaaaagctgatgcagttaggaaagggaagcctgagctattaagaaaaacacattgcttcttacatggtagtgctaaaggccaagcctgcatatccctgcaatctataaagtctgttttctctgacagtgtcagagttggaaagatcaataggtgtcactcacaccattcatcatctcagaaatgagaagatttaggaaaggagattgaaatgacttatgtggggtcacagaactagttattgttgagaccaaatttagagtcttgtctcctggatctcagtattatactttaattatttcttttttaacatgtaacccaatttgctcctaatagacttggaatacacagtgcctgaaatgtaaagatgacttactcttggccttaaggcatcaaatctgccacacgaaattttaagataagcataatacatcattggaattactcctgcttcttgtacctctttcacatgagttaccatgaagtgaactctatcttttatggaggagaggatatggaggagcataggagaaaggtaccatgtgaaagaataaataacgtctttgccttggactaagttgcattgcagttatcaccggaagttgacagctttggataataagcatggatcttttttgtctttgttggagcctgttgcccttcacctttatgtaacatctaaattctttattctggttgacatgggttgctttacaattttaacttggcatgtgtcatacgatcataggtataatattctacagttacaaaatatgtttgataagtatgaggcattcatgctcattgtgaaagccttcaaaatgtctgtacgctaggagaatggtgaaaaacaagcagtcaagtgagtctcagtgggttgttttctcagaccacgtggactctcttctcaaatctggtactggttttacgtgactttggagaatcttcattctcaatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaatgagccctggggaactcaatcccatcaaaggaatttcgagaggagttcacagctcctatctaccatagaagggagaaacaggataaggaatagatccctgataaagcacatgaacaaattaaatccattgttaatttgagtgactggcatagagaggtggcccctacaaaattgtcactttttagagtcacggtggttcacagaagaatagaaatcatcttttcctcttaacattatttccatgtactacagttccctctccctaaagtggtctacttgcatttgtcaacactgaaagcaaaaacaaagttgaatatacacccatggtgcatattgttaataaagaagatggaggcaattcagtggtattctaattgtaatgataaaaacttacctatttcatcagttcctctcctttgcccctaaaccccaaatactcactttgtctcttagatatcttgaagtagagttaataactaacgagaataagcatctccatccatgaaatattttaaatatagtagtgtggacctaaaaagatagtgaaattggataggccatgaatagaacaagtcctcatgtcataggcaaacatccagaaagttgtgtgttttgcatttgtgttttgttgtttacatctgttgcataggaatgatcatagttacaacagctgacatttaatgaggacttttcatatgttagacactgtgctaagagctttatttacatgctttatctaatttaatctgtacaaccaatttatgaaatgggcattttccagacaaataaaatgacgtttagtaatttcattttgattgcctgtagtcaccgccaataagtattagagggaatattgcaacccagtcaactttctccagagtttatctttctgtattcctcagctggttgttggaggttgattgaaaaaccctttgtaagccttgaaatgctaaatagtctacataggaaaggcttctactattgtttctacttttttttaatggtttgtaatctcagcagggattgtgttatctaaaaatctgcttgatgaggtctgagatactggcttttagaggtcagacaggaatgactgcaagataacttgactttctccttcccctctgctgctaaggggtaaggtgggagtggttctaggacttctgccatagaactagatatgtgatggataggaaatgaaaaaatgtgccactactgcacaatgtcaagagattaattggcatttaatgaaatatctgtgccatattattttatagtgtgcaacatttaaaacaatacacatgtaaaaaataaaaaataaaacaatatgcatgtatgcatacatacacacacacacttttagctctgtcttgagctgtcatctcctggggcaggcttaatgacaggtgcaattctggcctaattcaacctcttgaaattgaaaagggttagcaccactcagtggctgctaaatcctagagggcaaaacagcctcctgtgtctcatcccttcatgactgtctcatgggagctcgatttctgtctctttccacctgctaaccagattcgattttgatgctgtaccattggtagtaaaatatacttctttctggtaaaaggagacctgagaaagtagaaatggcattatttaaaggaatttatacataccatataagttggctggatggaccagccaacaagctcaacactttgtattcattgtttcttttaatactcatttcaagctcctggattcagtatcattatctccatatcacaaagaatgagggactctgaaaaactcaagaactttcaaggtcactcacagaatacatgcctgagctgggattctaactcaaccccttaagcccgatatcctgtactttttctgctatatcaggggtcagcaaatgatagccaatgggccaaatcttacatgctgcctggttttgtgaatgtttcatggaacacagccatgcccatttttttatgcactgcctgttgctgcttttgctttacaacagtcaagatgagtgcttgaaacagaggccacatggcctgcaaagctacaacattgagtggccctgtatgagaaacacttgctgaacccaataacaatacgtgagagatgtattgttattgacaataacgaaacatgagagatgtagctcaaatcatttaactcagtgtgtctacatctttttcctgtatcttcaaaatccaacaggataggtctatagatatactgtcttaagcccagcttcttgtatacatttattttgttccaagataacgtgcagaaacccgaattccagataggtctcttataatgagtcatgtttaagagggttctattattccactttgcatttctagaacatacttctttcagaataattactttctaaacctgttcacttagcaggcagatggaaatccaacatcctttggcagagaagagagaggaattttccactcgggcaaagtgaagcactggtcagctcgtggctgaaattttttatgtcatcccctggttctacagaagactgtaaggacagaggaatgaggcatttcgccttgggatcttcagactcagatttctgagtcaggtttgaggttcctgctgtcctgtgggcagtgaggcccagggattacaccaaaggagcaggaacccaatgtcacaggtcccctaactcctgcctagttgcccaggccacataggcacaggcaggggagctggctgatctcatttgtttgttttccgtgtccgttctcaggcagtgataggcatgctatcatctcaattcttaaataaaaccaagttgtatcgttgaagagcagataaagcaaagacagaagcattttaaaaggaattttgtggcttccaaagtacaagtatagagtatttctgagttaatgaagaaataattacaaaatatttttgaaaaagtgacattttattcatagtaattcatgtaattccaactgaagtaattgatactttgtaatagtaaggacctattcgagtgaatgtttaagatactaattatatatcaattttaaattatttaatatcaaaaaggcttgaaagcagcatattttgtgtcattatgtgaattcttgctttgccatttttaaaactatttgttttctcataccccctcctctttattttttatgatgtcaaagactgtgtcagtcaagtctgtctctatgtcatttgagtttatgtttatgtgttagtgcatttttacaagttaactatccagaaacatgcacactctgggcagaataaaaaatgtctaagttaagtgaaaaccactttaaagcatggcagccaaaatagctgtagaaaagtttatgctctattatgtacaattttaatagacatgatatcttgtttcccagaatacaacagattgactatcagtcattttgtaaaaaatgaaagcaaaactaacaatcacaagagctaagatttgctggccctttgcactgtcccaggcactagtctaagtcttttgcaagtgtttcatttttacagcaacacaatacatttcctactgttgttatccatcttaaggaggaaactttgtacagaaggtttaagtagctaatcaagttttcacagctgataagggatagagccagagtccacaagcagtctagattcttaatgccaatgctgtattgtctctccagaaaagaccactctcacctttccccttgttcttgataatacagttaaattattcatattcatagcataaattttctgtatcatatttaagaatacagttaaatattggtgcatattagaaagatttcacttaaatatgactacatgaaagtagatttgtcttttctaaaaaataaacaagcatttgttttctaaaaaatttactggcgtgcaccatttcatttcctaataattcagaataaatgaggtgtcaccgtggtccacttcaacagtagatgggcttatattcaggcaggaagcatgtcacctatacaacacagatgtgggtgattaatgaaaactaaatcatggggatgagatctttaagaagaagaaaaccaagttgtcttccagaagtgttttcagaaccccctgttttgaggttgtggatagacatgacggttttacaatgccaaaacagtctgttctaaagagaaaaagttcaatcaaccatttcacctgcattatgccgaagagctagtctttacagtcatggggctttaaaactattttgatagcctgtttgggctgcctctaaatatatcctccaaataaaaacctcagaaaatgtatcagagaaatgtacataattaatatttggcttaatatattgtcaactttgattttacatgtcccatccaacttgttaagccttctttgtggccattagtgtttactagagaataatatcatatttaattttctaattatgtgcgaaccttggagtcaggattagttgatatttttacaccttcaaatttataaacctagtatgaagtcccatctagactaacaaatgttttataatagaaatttaaatagtactccagttttgtttatgcatttgctgatggtctttcttgctatgaactttagaaactttaaatgtccatttactcacaatacacacacagcctcaatgacctaataagcagatttgcagagccataaccttgctggcttatgtcagctcgaagtaaaaggggaggtggtagtggtgaatctgtttttattactcagtgtttaatcataatgaatcagaggcttttatgagaaaccttctacatcccatgaaagatttgctgatcaaagatgtagagatttctgttttattagaaaaaattgtttagcacctcattgtggatacagaagacattgtttgttgaaaagtttaagtctttttacgctacattggatgtcacactgttctgagtttagtggtatcaggtcatcagattctgtaagatgtgattctaaaaattcagtcctagtcctaccgagtccattagagaaggtctgcagtatataaaactgtgacttaaaaaatgctcaatcttccatgcacataactgcctgatgactctcaagctcaggtgtgaccttcatagacaggctgttgtaaagtctagtaattccttcaacacaaggtaacttagtatttaaaccttgaccacacatcacttcagaattactaaaggaacttaaatatatgtcagagctcctcttcggaatataggacaatggagcttatgcagatagcattactttaattttaattgtacccatctgggttcttcgaaatggcaagtatttcgtttatgtgcctttctcatcttgggtcaactcagttccatgcactttaaaattattttaggaaagagccacatcttttttttttccttctttctctttctttctttctttctttctttctttctttctttctttctttctttctttctttctctttctttcttttttgtgcatgcatgcgtgcatgcatgtgtgtgtgtgtgtgtgtgtgtgtgtgtgtgtgtgtgtctcactctgctcgcccaggctggagtgcactggtacaatcttggctcactgcagccccgacttcacaagctcaggtgatcttcccacctcaccttagcctcccaagtagctggaattacaggcacatgtcactacactcagctattttttttttttttttttttttttgtatttttagtagagatgggattttgccacattgcccaggctggtcttgaactcctgggctgaagtgatcctcctgcttcaaaagtgctaggattacaggtgtgagccaccatatttggccaagaaccacatcccagtgctgtagaaaactccaaaaatttattttgcaattcaaaatataaaagtttgttagtagacatttagtttgttagatatttaaatctactagacaatctattatgtattctgctcagaaatggttaagacctactgatctagaagacggatctctctgagccataatttctgctcaaggcttgctaggggagatccttctaacttggctttatacacaagaagctagctcacaaaaatgtcggtattctagtagctatgcgtttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagataatgtccatttagttctgggtgtaaatgtcttccttgctcttccattgtgcaagcactttatgatttgagggagtaatcaggttatattccttctgttggccagaagtgcctgttgaagaaagacttggctctgttgtctggaagctaactatgtagactgatccacagaggactccatattcatcttcttgatactgagggcttcatctgtgagttgtaagcctgtaaatcctctgtttcagtggtttcaaagttccaagagcaggaggaaaatccagactgcctctgctgctgtgcagagcaattagacagtttgagtgcctcaactgttcctatacaggccagtggagtcagagccttaaaaagaccctcttctcccagtgctttctcaagtaagtacagcaacctcaatgtcttatagtatcactacagcacaatacatgagtagttttacatttgaagtaggattaaattaaaagtaatacattcacatggtaaactcaaaagtatatggccaggtgcagtggctcatacctgtaatcccagcacttagcgagactgaggcgggtggatcatttgaggtcaggagttcgagaccagcctgactaacatagtgacaaaccctgtctctactaaaaaccctgcagagacggccaaccccatctctactaaaactacaaaaattagctgggcatggtggcacgtgcctgtaatcccaggtagttgagaggctgaggcaggagaatcacttcagcctgggaggcagaagttgcagtgagccaagatggcaccactgtactccagtctgggtgacagagtgaaatcctgtctcaaaaataataacaataaatgtatatatagatataaattatatattaattctatattttatatataatatatactataatttatatacttataaattatataatatacaaatatatatttatataaattatatacctataaattatatatataattatatataggtgaatatatacagatgaatagttatatatgtagatgaatagatatatagatggataattatatatagatgaaaatatattcacatgttatatgaatatataagtatatatttatatataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatttagatggtccacttactacagccccagaatggaaatttcttcctcaaagcaaacattagaggcatcttttgggaaaaaaaaaaaaatctatatttatctcattctgttcttcatttaattagcataatccctgttggatattttcctcaccaaataaggaacctgtaattaagtgttatattacatgtgcttatttctcttcctggaagtccattttttaaaaatatttttaattgatatagcatagttggtacatatctttggggtacatgtgatattttgatacatgtatacaacatgtaatggtcaaatcaaggtgactgggatatgcatcacctcaagcatttatcttatctttttttttttttgagatggagtcttgctctgttgcccaggctggagtgcagtggcgtgatctcagctcactgcaagctccaccttccaggttcatgccattctcctgcctcagcctcccaagcagctgggactacaggctcctgccaccacgcctggctacttttttatatttttagtagagatggggtttcaccatgttagcccagatggtctcgatctcctgacctcgtgatccgcccgcctcagccttctaaagtgctgggattacgggcatgagccaccgtgcccggccaagcatttatcttttctttgtgtcagcaacattataattcttttcttctagctaattagaaatatgtaataagttattgttaactataatttccccactataatatcaaatactgtaagttattccttatatctaactctatttttgtacccattaaccaactgttatttacccctgctcttctccttcccagcatctgataaccatgatttcacgctctatggagatccttgctttgatgataaattcattaaggacaagaaccctgcagggtgttcaatatgcttcccaggtgccaaatagtctcaatacatattaacagaaagtcagtgtcaactcacctgcacctcacacagtaaattgatttaggcatctcagattcctaaactctctaggttaacacctcatatagtaatgaaagtataatcagttcacatgattgaaatcctctctagtttaatgtacttgttgcttttccatggactttgaaaacatgaaggtctgtagccgtgttgttgcttttccatggacttggaaaacatgaagttgtgtagccgtgtgtctccagacttttaacagcccagaaatggtttcaatgttctgcattaaataaatcgagaagggttagacaaaacagtgtctgaaagatttcatgctgtgagggtgatgagggtgatgggtgacattaatgaatctgaaatggtcgtgactacaaacttgtttttaaaatgtcactttctctaagagaacaaaaacttgaaactcaatgttcatgaatacaagaaggccttttcaaagaaaggccacgggcactctcactaatacacacttggcatttgggtatatccctaagctgtggactgtgtttacatatattactctttcttctcatcactctttaaccaaattgttgagtgtccaagatgccacatggtcaatggattattaccctgtggattcaaatctgttaccaattactctaggggtttattgagtggtcctgcacacccactttcctttgtttttctaattatcgctgcacagctaatcctagctcaaaaaatcaattcctctctcatatctacttacatatcctctttaagccccttctgtgtttttttgttttgttttgttttgtttttgttttatctcacttccatctatttcctggttatttcaggaaaagttcttttcacaccactttttagtggattccatcctgtctctcttcttgtgaccataaaataaaatttgtcataaacaaatgtaagagtctggatgtttctacaaacatttaagtggcaggaagaagctaaagccatatttttcagtcaaaatgttagcagagattttcctgcactgtgcatgatttattttctttctttatatttttagataccttataaattgtctaaaatctcaatgaacaacatttatggtcaaataacataaagaaaaatcctttatagccacttacttactcaattgtatagtgttttgacattctaactacactatcagtatggttttctgttataacgtagtataggtatagattttagccacatagtaggtgaaataggctatgtgttaatctagactaagacacagccattatctataacatatattttatgagaatttgcattccaaggtaaaaacaactgtttgaaaagttaccttttaaacaaatccagttcatatggtgcattactttcattttctgaaggtgattcatatggaagtattgagaagagaaacatcatagtttaaaaaaggccaatcagactttgaggacaagatccaaacattatgcaactttatatcttagcagagtgcacttagtaggtgttcaataactctttgttggataaatgactttatgagtaaatgaagaaaacctcagagctattggcttcctgtgccttgaattacacttttgagtgggactgccttctgcaagccagttgaaaaatagctattggctcacagagttcacctttattttgaggactctgtcaagacaccttagtgcatgttcctagttatgtgaaagatatgctgccaatcagaatcccaatggtctccttgtatgtttcatctttaaatggggctgcgctgttagggacaggatatatcttggcagactacatggatatgaaaatttcaaatcttcccatagtcctctatctttaaggaaaatcatggcacttgtttttgaatttttttaatccatcttccagattccaaaactaggaattccaaatgttgtttggacagactgaaaagagaacaaccaataggagaagtggtacactatgagtagtcaaggtaccatacacatgggaagtgtgaaggagacttacttagtatttacttatgtctctttgccaatatttgggagtttcacagagcatttctagataatgagggatggaagtgaagagtaggacaaggtattcaaagatctaagaagaatgagaaatcctcgatttcccatatgacaggatgacttggttacacgagtaaattgctttttgtatgtgaaacaggcagcaattggaggtagcaaaggaatacacaggtaagccctggagtccaattcccaaaattagtggtgttttctgattccctaactgactctatggtaggctcctggtcaaaagatccatcagggctgctgggcccatgctgacattccatatagccatcttctttctgattctctgtcttccagtgatgatccagctctttgcagcagcaggattgtggctggccagaagcacacttgatttcaaaatggatgtgacgggcaggtcacctccttttctgcagaagtgtacttgcatcaacaaatctttttcctctcaggttttgaggaaatgggatcaaacattccaacacagagaaataggaggcgtgggcagcagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctctctcttctcaaagttccaaagtgttaaagagttttgttctccggtatcaggagttggccacaaatgctttctctataagttcataattcctgttgggaaacttggaaaagagctctccccttctcatccaaagaagtgatgacttctctttgttagtttacaactaacaaagtcccatttctggtttgaaagtcagatggaccttggcttatatttatttaacaaagacgtggaatttctctaacagactgaaagtttattagaataacatctagcattaggcctggcaaataggaggtcctcgttaagagatctgatcagatttgacttctaatcccagatataaggtgtttattctttttgagccactatttcctcatctataaaataagaaatattcataactattccataatatgtattcttatatcctgtataataaaataactaatataggaatataataaataactaggaattataaataatataagattgtaataaatatccaaaatcaagggcctccttgaatttgttatatattgatttgttgattttttgagggcagtaatcaccacgtctgtccagatcagcgcggtgtccacgccccactcagcactgtgccttgtccatagcagatgctcagtcaatatttatctaatcagtgctgtttgtattcaaagagaatgtttaacttcttactctttccattcccacctcccctttttgatctcatgtccactatcggtgtactgaggtctcctgggctctgtttgcaggaatctaaaagtagtttttttactttggtactgggacatgtaactccactttttagagaaaatatttcatgctaattaaaacatctcagggctggtctccctgcacttctcactttcacacctacatactcataccccttttctctttttccttactttgtaatgctattagagttgacagaatacttgctgcttccccagaaagtcttagccaggagttcatgaaaccctgtcaggccttgtgaaatgtacagatgtgtttcaaatgatccataaaccctgatattgtataaaatgtgtgtgccattttatggaaagaggatgatatgttttcttaaccaaaatctttcggggtacttcggtccataaaaggctaagatccactccactaatgagcaagatctagtcatttagaaaatcctgcactctctcctttgttactgcctcaatttccttaaaaagctcttataagataataaagaagccctctttacttcctacagttccactccacagcaataccagcttaagtgtgtgccttccagcgtccatcccatctctccgtctgaggggtccccactcctagtccacccaggccaggaaacccataactcatatgtaccagaaaacctcctttttaaatttcctcatgcttcctggcaccctgacctgacaatggactagtacctcatatccacttctaccatgacttctgagaaagtggtattttttaccacagtgaacttggtatatgcagtgtgtgtcaggggcactggccttactaaagtagaggcccattctggagaatagtaagaaataaggagcaatacattgatgaaatagaagggacattaagtgatggtcacagaccactcttaggactgccattaacttcagatgttaaagaagtgcttcagctctctgtgctttgtcttcttcttgacaagtgaggatgttaggattatctgccatgtcatccagcttcaatctctataattgtataaatctggttggcagtggactcgttagtgcaaagtcctaaagccttaaagatccgaagttttctcactgggcaagcaatttgcgggattacgacagtgaacttggtgtatgcagtgtgtgtcagggacactggccttactgaagtagaggcccattttggagaatagtaagtagtaaagagaaatacactgatgagacagaagggacattaactgatggtcacagaccactcttaggactgccattaacttcagatgttaaagaagtgcttcagctctttgcactttgtcttcttcttgaccagtgagaatgttagacgggattatctaccatgtcttccagcttcaatctctataattgtataaatctggttggcaatggactctttagtgcaaagtcctaaagccttcaagacccaaacttttctcactgggcaagcaatttgcgggaaattaaacaagtccaaaatattgaacaaatgaagaaaggggccattttaacagacaggaatacttcatactgtaaagatggccaggtgtagtggttcacacctgtactcccagcactttgggaagttgaggcaggaggattgcttgaggctaggagtttgagaccagcctgagcaatacagggagacctcatctttgctagaactttaacaattagctgggcatggtggcatgcacctgtagtcccagctatgccagaagagaagggaggattgcttgagcacaggagtttgcaactgcagtgagctatgatcttgcaactgtgctccatcttgggtgacagaatgggaccttgtctcaattttttaaaatatatatatacatatatatatatatagagagagagagagactatatatatgtgtgtgtgtatatatatatatacagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaagataaagaaaaatgggcaaggtttgaataagcacactttgtcgaagatatatggatagccaaaaagcatataaaatatgaccaaaagcctctggtgtttagagaaatgcaaattaaagctaaaatgagattcttctaaatacctatcagaatgtctgagattaaaatgactgactgtagcaactagtggcaggaatgtggaggaactgaagttctcatacactgctggcagaaatgtacgatgacacaacccttttgaaaaacattttggcagcttcttaacaatttaaatgtacatatcccatgtaagccagccagtccactcctgggtatttactcaagagaaatgaaagcctatgtccatacaaagacttgtatgtaaatatttataacagctttatctgtaacagctaaaagttggaaaccacccaaatgtctatcagcaggtgagcggataaacaaattgcggcatatacagtgtagatagtggaatactactcagtaataaaaaggaatgaacaattgacacatgctacaacatggatgatgcaaaataattacactaagtgatagatgctagacgaaaaagagtacatactggctaggtgtagtggctcatgcctgtaatcccagtactttgggaggctgaggtgggcagatcacctgaggtcaggagttcgagaccccccaggcccacatggcaaaaccccgtctctactaaaaatacaaaaattagccaggcgtggtgatgagtgcctgtaatcccagctactagggaggctgaggcaggagaatcgctagaacccgggaggcagaggttgcagtgagccgagatcgtgccactgcactccagtctgggagacagagtgagactccatctcaaaaaacaacaacaacaaaaagtgtacatactgcatgatacaaaattctaagaaaagaaaactaatctatataaaaatttttctctgttattctctactgagaggggatgaggaggattaccaaggggcaaggaggaccttttggaggtgatagatgtgtttattactgggattgtgttgatggcttaccaggtatctatgtaagtcacaactcatcatatggtatactgtaaatatgtgcaggctgggcgtggtggctcatgcctgtaataccagcactctggaaggccgaggtgggagaattaaggccaggagtttgagacatagcaagatcttgtctctagtaaataaataaataaataaataaataaataaataaataaatgcacttttttgtatattgagttatatctcaatgaagctgctttttttaaaaaaaaaaaaaacatataacataaaagagattaacagaagagattcaaaagtctagaacaccaaatattaaaggtagcttttcaaatcagtgagaaaataatgatattacagaaaatggcaaatcatctagaattaaatttctacttcatactatcagcaatataaattgcagactaatctaaattaacaatttaaaagataaaagaaactatagaaaaatacacaattatgtatctgttcttgaatggaaaaagattttccaagcgtaaatacaaagaaaaatttatatagtaaaacaatgattgatttaatttgataatttttttagaaagtttacatcaaaacaaattacaaaattgaaaggcaaatagcagtctggttgtggtggctcacttgtgtaatcctagcactttgggtggccgagatgggcagattgcctgagctcaggagttcaaaaccagcctgggcaacgtgatgaaaccccatctctactaaaatacaaaaaattagccgggcgtggtggtgtgcacctgtagtcccaactactcgggaggctgaggtgggagactcccttgaacctgggaggtggaggttgcaccgatctgagattgcatcagtgcactccagcctgggtgacagagcaagactcccgtctcaaaaaaacaaaatggcaaatagcaaaggggataatatttgccacaaatataaaagaaaaggatatatccttgctatataaaaaggtcctatgaaacagggacttagttggatatttctatttttaaaaaggcaaatcatataaacaagtgttttacccacccatcccccctcaaataaagaaaaaagacagggatggagaaagaagggggaaaaaaaaaactgagtaaaaaaattctttgcaaaagagtaaaaaagagatttgtttcctcaccttgatgttgtctttataagttgttttattttaatcttttgtttttccatattttcagagttcctacaatggacttgtagtacggtacctgggtgatcacaaacataatctagggagtagaaaagaagttcaatgactcagcatagtgttaatggtcttccagatgaaggaggggacatgaacatgtgtctgtcccaataaaggttgagacaaggtttgttgtgcacgtgcgcgtgtgtgtgtgcgtgtgtataacagtgaggagactgtaattagcaggaaaaattggggttttgaaagtagaccacagtcttgtcattgtaccatgactcaccaggaggacagaggacaagtaccctactcctgtgtaaatccagactgccaagtagagcactgagatttgatgagtacttaagaaatgcttgcttgattaattggtaaaagatattaaaggggaagattttatatcacattcaaacatatgaagagaaatgttaaaaatgtttaaagttccatttccagtctcactttccaattcttggttcaaaatacaaggggtaattagacatcgactgtgtagtcaacattatgatcaggctatataaaatcatgaaacatcatcctaaactttaaagaactttgagtttagctgggaaaatatgctcacaggaaataattatgtaggaaaagaaggcatcaaaagggcttaaagcaaccaatcacacagagtttccttgttgggaccccccccccacccgccgggccccaccccgttgatatcctaaatgttctcttgacatcttggatttaccatagagcctagtactgtctgtaaggtcctgggcctgttctaattagtgctgagtatctgttgatctgctacgtgcaaatgggaagataaaactaaatgttagattagggtcaatctttaaaactctttcctagattgtgatggtattcagtggtggttgaccatcatggaattgggagatatttgtgaatgtggctgcaggctgcatgtcctttgtgtctctgactcaagacacacccattgatctcatttgtcttcatttcatcattgggcagaatgcgttctaaaatgaagagactaaaaccttcacagaagcacactctttcaacatctaaggaaaaattgttgatgagaaaactgtgagaacattaggaggtctttaaattgcaaggggaaaggtctgttggtgaaaacagctgaaatcctatggattaaatcaacttgtaaataatgtattcttagagtctgcagtgatctcataggcatgtttaaatgctgtttcttatgactacagtttaaagtcatggtatggactttcagtttcatgaggctggcctgggggaaaagagcatgaggttgaggttgatggtgttaactagagcaactgagcccccatacagaccttctgaacttgctcattaacgaagccacaggatggaaattgtatagtgtccttgaccagagcattagttacaagttgtgagaagagaagaaataagtaagaaagaaaataaatgacttataaaaatcctcagaagatatagtccccaactgttagcacaaagaaaggatgtaaaatcatggaggacagcagtggagaagataacgttagcagacaataaaaggccaaagttttagaacagtagtaagtgtttaagaatatacataatatatcttcctccatttgctttttgtcttcaccataaatagacatgagttaacgtatgtttaaagatttatttcccttttattgagctcacccaacaaaagtttttttcatcatgtcctgcttttacaaaccaagatctaatttgacatgattacgtaattgtgtggccatttgtgcccttccttctcctcctcctttctctaaagtagaaagcctctctttcctagagcctatgtaaaatgtgttaattcgcttaatagcaataataattttcttatgacaatttatctattcactaaagtgttattaaggacctattagttggaagcctctgtgccagctgttgggaatagaaaaatttataagacactgtctttggagctttcaatctagtgggggattcaaacaattaaagagatacttttaaaagacagtgtaataagtactctggaagatgtggcagactgccagttgccttccccagcataacattttcccaatattcattaggaaaagaaccctttaattgtacccaattaaaataccgaatctcccagcctcttctgcagcagatgtggctgtgtgactaagttctgtccaataagatataagtatacatgtttggtgagatttccaggaaggatgctcaagtggagatgactaagtcagaagaaagttccttttagctttcctgcattcctagaattctgatgcaaaagctggagctacagcagcaatcctggactatgaggtaaccttgggagtactagggaattgggatgctagtaactttctagaagcaccaactcagccccagaatgcctcctgctgacttcttttacgtgggagagtaagcatttgtgcatttaagccactatagttggatatttgaccattgcagacaaaaataagatcaaccgatagaatgccatttatgaaaaaaaaaaaaaaaaaaaaaaaccatgggagtggttctcctctctgttatgatagggagaggtcagagatgctgtccctgaagaagtgacattcacactgagacttaagggagaaatgagtgagcaaggtataggaaagtatttaaggaatatcatctgaagctctgaattagaagctatctacaagatactaaaagaagatcagcatgacagaagtacaggaattaagaagaacatagtaggtgacaaggctgaaaaatctcatagattctccattttgcagagacttatagatcatcttcaagatagtaatagctgcagagcagaaggctagagcagagaaagaactttgagagataccaatatagacatggtttctaaagtcttaggagacaataagattacccaggaagagtatttaaagtcaggagagggccaaagacagaaccttgagatccaacacttaaagatcaagaagaagagagtttcctatcttctgtttcttaaaaaataaataaataaataaagcatatcagcataattcagagtcacaaattctaagaaatcatggggcagagggcaggggtgaggtagggtttgttttgttttgttttgttttgtttgtagataaccaaaggaagaaacgattgatgcaagatttcagggagggtgaatagccctccttgtagctttgccctgctagagagatggtgggtggacaattactataatatttacaaacaggataagtctacgtcagcccctaacattctcagtttcgttatttgtaaaatggcgtaatgatacttatcttttagagttgtttgaagagtacataagagacggaaaaggatttttaattagataaggaaagcataatcacctatctttgattcattcacccttttaaactgattaaagcttagaaaataatcacatatgcagattgatcttagtttgtccacctcttgacaatcagttagtagtatatatgtatttttttatttttaagaatttttatatccccatgcattgactaatcttgccccatcatagataagactagaacaaaatattgctttgagaagtccttgagttccaaagatttaccatgaagctaatgaaacctgcattgcagagtccttcactagtatggccttttccaatgtcttgaaaggagtcctagtcacatgttcacatgcttacacatttatgtaaaatatgcaggataagataattaaactacaattatctaagatggcagtctttttttcactctgattttctgtccaaaatattcctcttgtggaagtaggtttggaatggccctgaacattttcggaatctgaactgagagaaagttgagtgaaagatacattgatttaaggcatagtgagatgtctagtaaagttattgtaaggtattccagtgttgaaaaggcttccagaaatatgccaaaaccgactgtgctgactcacatgatgtcatgccagaaagatgaagggccagagattgtatgatgacctgagtttgtccttgtgcaacaagcaccaatggcatatgagtgttgatgggacaagttttgaaatgtatggagccaaaagctagcctgtggaaagttctaccaggcattcgacatgtggtaaggtaaccaggagactaagttccgtggatgtctagtcaaatggaaattttcttctctcaagaataaacatgataatttcgtgtatgcaattctaaattcaccaaattgtgttttctttttcaatggcaatttcaggaaattaaatgatcagaatccccatgtttccaggggccaaacctgtaatagtcccacagacagtgagtgtgtctataacaactaatataggcagaaaaattcaaagacgttttctgaaatttgccaatacctgtaaacatttttaggacattgtcaaaataagctgtgaagctgaaagaagtttatttaagtattaataataaaaatttaataagctatgctaaataccaattctctttctattatctctatagaaaagattttacaaaatcattctcagatgtagaagcaatttttaaaaattcagccaaaaaatagtagggtgaaaagtattataatgatagcaggtagttaattaatagcatgttctttttctgaattttatgatgcttgtggctttgacaactttaaacattttataattgtggaatttcttttgtcgttttacagaaatattcagttttgtacctcataatttgtatttataattttgtattcttcttcataaaaagggccattgaattgtgtttaactcatgcctcaccaaacctgaaccagcattttcctctgttgaatttctattgcctgcctacagcaaggcccacgtcttcctgtaacagttgcccccagttcccttaactatcaccagggagtcagcagttaatgacatgctcaaccttcctccaattacagatggttaggagagaaaacaaagccataaggccattaaactcatgaggttttgactggtggttcggaggtagagctggccctggctatatctgccgtgtacacaagaaccaaaaataccacacttcatttcagaagatccagatttgatcccacctctgccactggtgtatgatcttcagaaatgaacttggctgtccgaacttcaatccccttattcatacgatagacctattgtgatggccggcaagctgaggtatagaaacacatattatatagtaaggggttcttcaaatgtaatatctgttctcaattcctcttctctatcattaccaaggagccaatgatgcacagctacccatgtaccttcattgtagagacacaccctgaacaagcagacaacatggcgccacatcagagtattatattagaatgtgtgtttggcatttctttagcagaggggccaagtgtaggaagggagcgggtagaaaaggaggaccacaggtgacaagagtctcccctgaccttaagcttgcagttcccactgaaccaaacagaagccctgtatgcatctggaagtccttgcttagtgggctgtgcaatgtgtgttttaggggtctcaagccttcatcccatgtagccatggacaacatgttccaggaaaacattacttcctcacttcattacattccaagtgacatttctgcatcccttcttgacgaatgttgtccaaaattggttgtccctctctttgatccagctctgaccacagagatcagttttacatacttgggtacttccccttggtgattcaagaggaggcactttccttaaatagccttggaaaccttgagacagctgctgcatccatctatgttcattgctcaaacttcctgtatggtttgccaccaggcttaggttcaaatccaaaatcaaaatcttaacatggccacccaggcgcatgtggcctcagtaatacacagtttttgagcttcatctcaagcttctcttccccttactttgctctccatgcctgcttccagctcttctgcttcacccagtccttccccatccctcatgtcacacaggttagcttctgtgcccaagtagggtcctgcttcctttcacaaagctgactcccatgagctctccagagatgatctcaagtgtcacttttgtggggataactaccccagtgacaccctcctccagatttggttagcttctcccattccagcctagtttagatggaatcatattaagttgctggcattaatttattatgacctacaaaaccatcaatagtgtacagttctcacaactcccttgtacattgcagccctcatcaaaattgttatgaagtaattgatttgaataatgattaatatctgactccctgatggtttataatctttgtggaagtagacaacatatctatcttgtctactgctatttagcacatactaaataccacctagtaaatatttgtttaatgttacttatttaactgcagagatatactttttacattttctacatttaagatgcacacggaatatgcgatgttgtggagaaaagagctatttgccaaatggttacttgttactttatttttctaaggctttgggcataaaatgccattatggaattactattttattacaatggtatctgtagtactttggccctaatgttcttttttggttatgatgctgcactatgcctgtggaatacattctggatgcatgatgagactactgagacaatcacaatcttgtaagtttccttttcttctaagataaatctcaagcagagattctcttctcaggaagagtagaacttttcacaatctcgagccaagtaaacactctcaaattgcaatgcaaaagattttgcaaaatacttgaaaaaatgcaatttataaagcagaagttgtacagatgccatggaagatctaatgaaaaatcagaaaagattgcagcacagatttaactcttctcaagacagcaaaagcaccccacatgtgacagatactcatgagaacattgggagcctgaagccccgttttccagacaaggaaggaattacgggtctctgatcacagcagaggggccctcattagacccatcaaggattgcacgtgccctgtgcaaggccacatgcgcatggggtgtgcaattaactctgcccatgctgctgaagtttcagtccattagtctgagtgaatcttggtcatttgtatccctcttggtgcctcataaacatatgcctcatagtctgcatcttcaaactttttccatactgtaaaactgtcttcgcaaaatctcatcacaagctgaaaagtgatccctggtgataaacaactgagatggttattcacctccatgactagcctttcagggcctcactttctatatccatcaaatgggaagaacaatagatgcctcatcctcctcactatgttgctgtgagcatctgttgaagtagtggctattcgagtgcattgaaatgcatcagtcagtacacagatacaagggcttctgataactcatacctgaagaatttttgtcaaccctgaagggatttgcttcttggtatacgggtattaaaatactagtataatttctctaacgggagtatgatgtcactagttccagagtcttttcatagatggatgggttttatgataaataactcaccctcagtgttaacttggctttccaactagccaaacaggcctttgtggaacaaggttagcaaatagcatttgggcaaacgatcaaaagggtctccctctcttctatcactctctttatctctcttggtacctctctctgactttctctccctcctttaaaaagttatctctgttttttttaattttttttacattaaaaacaacaaatgggcccttcagaatagtcgaaaactttagaatgcaaagatatcaaaaaataagaaataacctagatcagaaaacagataaatgattgccaggggttgggattgggaggagttatttacaaggtgaatgaagaaattatgaggggttgtggaacttttctatattttgatcttgaaaattatataactatatacttgtgttaatcttgtagaagtgaacactaaaaagggtgaattttattataaacaattttttaagagaacaaaaaatgtactataatcccaccagccaataacacactattaacactttggcgtacttctgactagtcttttttttttttttttttttttttgctggtgtttcaaaatgtcattatgatcatataatacacaaatatacatatatgtgtgcatatagatatctacagatgactaagatagatgattgatagatgatagatcagtgaatagataaccaaactcaaaacaaaatagttaattcatgcaacttgcacaaaaggtacaagaaatatactatgaaaagtctccctctcccctttttccttgggcacctagctagttttgttttagtttttacctagctctcctgagacagtgtgcatatataagacaaaatatacatatacctcttttgtaatactaagacaccaaattcatacttctgcatcctgccttttttctttacttaacaatacatcttgaagatggttcaaattacacatatatagataatttttcatgactgatttttaatagctgcatagtatttctatattttaatgcactgtaatttatgatattgtattgacaaccacccgggttgtttttaatatttcatttttacaaataataatgtgataaacatccttgtacttgtgagatttcttttcctatatgggttatttatctttagtagagcttcttagaattggaattgtgaagtctaagtccacattttaagttttgctagataaagctacattgccccctttaaagttgtgccaatttttactccaactactgatatatcaaagtgtctgttcttgtatcattatcaaaattttaatatttaattatctgatgagtgaaaaatgacatctgatagtcctgtcagttagtattgcttttaatgtgactaatttttagcttttattcatgtttaaatgaataaaatgtactccctttactactttttttttttttttttttgagacagggtctcaccctgttgcccaggctagagtgcagtggcgtgatcatggcccactgctgccttgacctccagggctcaagcaatctgcccacatctgcctcctgcctgtgttgctcagactggtcttgaactcctgagctcatgcagtctacctgccttagcttcgtaaagtgctggaattacaggcgagagccaacttgcccagccctgtatttcctttactttgaactgcatttgtgtatccttggttcatgttctatttgatagccatttcttcttaattagagggatttcttttttttagattagaaaaactagcccttttggctatgataagtggtttatatttccttttgtgtgctacttgccttttgtctttatttggcttttttttggacttgcattatttatttaagatttacgtagttggatttctttctcctttcacatatggcctctctcacttcaatattatgtagaaaaaaacctctgaaataatgaattcctatacttttatgggttctttttttattttgatatttgacccatctggaatttattttggtataagaatgaggtagattttcaacaatttattccactaaatcataaattagtacaccttttttccataaatggctaaatagtaaatattttagacttcatggatgatacagtcttggggcagctactcaactctggccttgggcgaaaaagcagccacagacagcacaaaaaccaatgggcataactgtgatccggtaaagctggtgtagacacacaggcagcaggaggatttgaccctcagattgtagtttgctcacccttggtgcagaagattacttaattattctaacaaaattgatttagtaaataattttccccattgatatgtcttggttcctttataatacacaacattattttttataggtaggtcttgtacaaaactctccatttgattttattgttctgtctttctattcataggctgggtatgacactaatttggttactatagctttatgtatatttttaacattggatgaggtcagttgctcctcaaaactcttatttttcagaattttgtgcaggaatatctgagtatttctaattagattagaatgtcagaatacattcatggacatatgagtttggggttttttaaaattttttttagatatccttcaccttgaacatttattatttctttgtgttgggaacaatccaaatctctcctagatgttttgaaatatacaatgtattgttaactgtagtcaccctactgtgctattgaatactagagcttgttccttctgtctaactgtatgattatactcattaaccaacttctcttcatctgccccccacctccacccatctcagcctctagtaactaccattttactctctacctccatgacattaacttttttagctcccatatatgagtgagaacatgcaatattttgtctttctgtgcctggcttatttcacttaacataatgacatccagttccattcatgttgatgcatataacagatttcattctttttatggctgaatagtaatccattgtatgtatatacacatataacgtctgtatatataatgtgtatataaaatgtatatccataatatatgtatatatacacatatatgtaatatatattgtgtgtgtgtgtgtgtgtgtgtgtatatatatatatatatatatatatatatatatatatctcacttttttttttgagacagagtcttgctgtgttgcccaggctggagtgcagtggtgcaatctcagctaactgcaacctccacctctcggttcaagggattctcatgcctcagtctcccaaaaagctgggactacagtcatgtgccaccatatccggctaatttttgcattttttagtagagacagggttttgccatgttggtcaggctggtcttgaactcctgacctcaggtgatctgcctgccttggcctcccaaagtgctgggattacaggtgtgagccaccgcatctggcctcacattttctttatccattcatccattgatggacatttaggttgcttccatatcttggctgttgtgaatagtgctgcagtaaacatgggagtacaggtatcattttgatatactgaattcctttcctttgggtaaatatgtcatggtgggtttgctacatgatatgatagttctacttttagttttttgagaaacctccgaactattttctacagtggttgtactaatttacattaccaccagcaatgtataagagttcctttttcctttttccacatcctcactgacatttattactttctgtctttttgataatatccatccttactgagggaaagagggtatctcactgtggtttcaatttgcatttccctgatgattcgtggtgttgaacttttttttttttcagatacctgctagccaattgtatgtattcttttaagacatatctgttcattcctttgccctctttttagtgcttttacatatttggcttttgtttttttgttttcgttttcattttgctgttatgttgttcctggatatacaaggaactcaaactatagtcctttgtcagatgaatagtttgtaaagattttctcccattcctcagattgtctcttcactatgttgattgtttcctttgatgtgctgttagtttttagtttaatatggtcccatttgtctagttttgttttttgttgcttttgaggtcttagccacaagatcttcgcccagaccaacatcctgaagtgttttccctcttttcttctgtagctttatagtttcaggtcctaaatttaagtcttcaatccattttggtttaatttttgtaggtggtgagagattggggtctagcttcattcttctacatatggatgtccagttttctcagcaccatttattgaagagaccatcctttcctcaatgtatgttttcagtgcctttgtcaaaaatcaatcagctgtaaatacatgcatttatttctaggttctctattctgttccattggtctatacgtctgtttaaacaccaataccatgctgttttagttagtatagctttgtagtatattttgaagacaggtactgttatgcctccagttttgttttttgctcagtattactatgagctatttttaaaaaatacttccaaagaaaaaagtgcaaaagtttatattagcttactatagttttaataggttaaaattagtagcttctgagtaatgaagagagactgagcttaatttctcctgctttgaaagtacttctagggtctgggtgtggtggctcatgcctgtaatcccattgttttggaaggtcaagacaggaagattgcttgagccccagagttcaagaccagcctgggcaagatagcaagaccctgtctctaaatttttttttttaattaggcaagaatagtggtgtgtacctgtagtcccagctacttgggaagcttgagcccatgagtttgaggcaggagcacgctatgatcatgccattgcactctaatttaagcaacagagtaagtcctcatctttaaaaacaaacaaacaaaacaaagcaaaacaaaagaaagtacttctatttatttcttcacctgctaatttagcttgttcaagtgtagaagctggaggatgtttccctgcaatgacagagtagccaattttgtatctcctgattttttccttctctcattcttctttgctcaacagacactaaattgaggtttgtgtccttgtaaatagtagatttcatttaccctctgccacctttgtcaaaaaataattttaatttaaaaaatgatgtaaacttattttagcaaaattgaagactatagaaagctatgaaagtgaaaatttaaatcaccgtaacactgcactcagagataaccactgttaggacttttatttctttctttctcttctctatacacctgtaacatgcatgtacacctactgcatgcatatgtgtatgatacatgtgcaaacagtgcatgctaacattttctaccctgcttttccatgtgttatttttatcctgtgttccactattttggaaaccgtcagggttgacagagggaaattgatcaagccctttgtcttcattgatgtcaagagtttcagtcaacttggaggccgtggcctcctccttacaggcttcttcagcctttggtttgagtttgggttttttacttttcatttttggaggagccacgttctctctcctttcctattactggagagccgcttcctctcttcactcattcattgtgcagtgtgggggagtcaggacccagatgggaaagaaagcatcttgccacactcaaatctcatcttttttgccatgtttgccccatggcatttctctcagcatcttcttgtgctttttccaaaacatataaaggacaattctactctggaaagtcactgggatactgttctctgagaacaggtattgagaagaagatggtttcctcttggaacttggccaactggctcacagcgaacgtggtgtggactcttaccagctctctctagtatgctaagggcccccaaccagggaccctgaaggcatctcaagagagcagtgtccaggtctgcccttgttggaaggaggatgatgtgaggagatcacctttattaaagctgcaggttgtctgccagattttcaaatttcaatgtaactttttatttaaccaatgctgattaatagtagtggcattgttgaaatccattccccttcatttcattttctaatgaaatttcggatttctacacagacatggttttctggcataaaaagcttgcatttgcaacctgtcatattgggactgtgcagaacttttccatgttttaaaactcaggagaaagaagtaaagatggtaagagtgcacttgagcagaaacaaagggctgtgatcccaaaacaggggacaaatgagctgcaaaggagagacaccaagagcggagagcaagaggcaaagtgatatgaaagactccaaagtgctggttcagagaaaagaaaaaaaagggacataggtcaggaaaggggagaaggactgacatgaactggcaaatggcaacagatataaaaagccagctttctctggggagtggaaatgtttctaagcatttttgttcatgttagtatgatttgttttttcctaagtaagcttgaaaatcatagagtgaataggagaaaccaaagattagggaaaatatttttagaacaagctcagggaagtcatataggtttaaaatatatagtctatgcaaataatggcacacatttcagaatggaaacaaaaataagtggcagataatgtgtccaagtaatattggtagcaaatggactgttacgagagcaaatgatattttgcagagctgagagtgtgacctgtcttcaattatttgaatccctatcctacaaaagcattgaaaaaggaagatctggagccaatgactgtgtattacatatattttcattcagtacaagcagacatcatcagtgtgctatatactactttcattattattattatcttaattaaagctgtcttacgagccaggcgcagtggctcacgcctctaatcccaacactttgggagaccgaagcaggtggatcacttgaggtcaggagtttgagaccagcctggccaacatggtgaaaccctgtcgctactgaaaatacaaaaattagccaggcatggtggcaggtgcctgtaatcccagctacttgggaggctgagacaggagaattgcttgagactgggaagtggatgttgcagtgagccaagatctcactgctgcactccagccaggatgacagagtgagactctgtctcaaaaaaaaaaaaaaaaaaaaaaaaaagacaacaacaacgacaaaactgtctcatgatgaaatgggatgctttcactagccgtggttgctcatgcctgcaatcctagcactttaggaggctgaggcaggtgaatcacctgaggttaggagttcaaggccagcctggccaacatggtgaaaccctgtctctactgaaaatacaaaatttagccgggtgtgctggtgcatgcctgtaatcccagctactcaggaggctgagacaggagaattgcttgaacccgggaggcagaatttgcagcgagccgagattgtgccactgcactccagcctggacaacagagcagaacactgtctcaaaacaaaacagaacaaaaaaagaaaagggatgctttgtggaacagggagattacttgcactggaattgttcaagccaagttctatcaacatttgacacagaaacacatgaccatcgtaaggtctttcccagctcagcattctgtgactgcgtggtctttgtactgagttttacatgatatggatttcttaccttagaaggatcagtttttaaaagatgggctgaatgaatcaaatcagagaacactatttgcctacccaatatctagtctccacagctagctggggacactttatagccacgttaaaaaaacaacagcaaaaccccactgcatttctcaacttctgtagcagatggaggtggtcaagtgactaagttttagccaaagagatattagtgagaattgggagaaactttgagattccttaagaagggagacagaggatgctaacatggaacttgtcctttgccttcccattctcctttctgccatctggatcaggatatctggccatgctgaaatcatgagacaacatgaaggataaaatcctcaaactaagaatagaaatcagaacattaggacctggtctgagttcattgtggagcttccccagcccgctcaggctgcccccagtcttcccatttttagaaaaattaaaactatggtttgttaaagcttctattctgatggtctctgttacttgtagctgaacgcaatgaattgtgagatacgatttaccacaatttttttctttctttctttcttttttcttcttcttcattttttttttttttttaaaagggttgtgccatgtcacccaggctggagtgcaattgtgcgatcatgactgactgtggtgtcaacctcccaggctcaagcaatcctcccacctcagtctcctaagtagctgtgactataggcatgtgccaccatgccaggctaatttttgtattttttgtagagatggggtcttgctgtgttgcacaggctggtctcaaactcctggcctcaaacaaatcctctctcctcagcctcccaaagtgctgggattacgggtgtgacccagtgtgcccagcgctgtttactgaaatttttttttttatgattctgactatagctttaaacccaggctctgccatctccatgctgtttaacaagttctctgcccttcgtctgcctcaccagatgtattatgtataaaaaaaagtcacaacctagattgcagaatttcatgtaaatcgcttacaaaacaacacagatagaaggcagcaattggtgagtttgatctttggtgcccaaatacagctgtgctatttggtgtatacaaatgtcaccaaattcctgcacaaatttgcgggcgggataggggaagaaggaagggatgatgaaggcaatggacacaacagtctaaaaagttttaaaaaattgaatgtaggtaaaatagagctcagaattcctccaccatcatctgcatttgaatctggggagaagtcagccctcccaactttcacttcctactagaatagcaagacacactctgcctccagacagtgtggattatctgccacccgaactgaagtttcaatcactcaaatcctggtgtcatttacattgtttctactgggaaaggtcaggtgtctgcaggggctataagcaaagaaaaacccatcccctggaaccaccagtgtaaaggagagggaaggcgagtgacagcatgtgtcgatgctggatcattttcaggggtaacagaccactacatcctgaggctttttagcaaataggaagctgaaggacaaacatctgaaggagaaattaatctccgtgagtaggtgacaagctgcgataagcccttggggtgtgtgtcagtgtagcacagatgttagtgtgagaactattacttgattcaagggaaaggggagaagggcagggaggggggaaatgacaatgaaaaacaaaacagtgaaaaccacaatcatcttcaccaggcagctgatttttttaaaaaggcatatatccatcaaaggaacaaaacattaaaatacacccatatggcaaagacctggtgtaactggaattttcacctcctgattttgacagtgtaaatttgttcagcccttttgaagagcaatttggcaatgtgatttcagagccatagaaatatgcacatccatctttcaaatgtcccagctcttataaatgtatctttaaaaagactcaaaaataatttttttaatttatatgcctgaggtgtttatttcagcatctctacaacgagaaaaatgaaaaccgaaggtttgacatttgagacaatattaagtaaatcaatacatgctaatttaatgggatggtattaagtaaatctaagaccagcctggccaacatggtgaaaccctatctctactaaaaatacaaaaaattagccaggagtggtggcaggcacctgtaatcccagctactggggaggatgaagcaggagaatcgcttgatcctgggaggttgaggttgcagtgagccaagattgcaccactgcactccagcctgggtgacagagcgagatcctgtctcaaaaaaattaaataaatcaatatatggtaatctaatgggatgctatgcagcactaaaagtatattttaaaaaaaacttgagaaatgcttctaagatgaataatacacaattaagtcaattacctgacttcaaatattattataactgcatgtggacaagaagacaaaaccttcaaggaaaaaaagttttgatattatgagattatgggtaacattgtattcccagccttgaatttctgttattgttactataatatgtgtacaatttttttttagtgaagtaaaacaaacaagtaaaagaaaggttgaaacttcacaatgtagagatcaaccagcctgaacctctcattttacgggtgacaagttgaatacaaaacttcggtggaattgaacgggcttatttcagtggaaatagtgagaaatactcattttcccaagtgcctattagaggtgctgtcattttccaggagccaatagaaaaacacataaaagcagtgcattggtgtgatctgggctgtttctctgaaatcactcagctcgctttcaactgctgcgttccacaacacaatgtggttctacattaaccacattacatcataaagagatcattaaatgactccttatggaaagggagggaagaaatgatgtttagagaacctggtagtatcggaggcatcatcctccttctctgctgcctatctgtgtcgcactcactcttgaggttatgcaaagaaaatgttgacaatttaggtgccagctgttgtttgacgaatagcaaataaatgactgtgaagtcctttggaaaacagagcaaaaccaaattagtgattcccctcttctgcctcccaacatcttcacctccagggccttctttacactgactatatttcctctgatttcattgtcccaatgagacagtaatcctactgagagaacagatagggttcttggagactagaaattatgtttattgaatggttaaggcattgtttttttatcataagctataatttaaagttactaagaaaacaggccaggtctctgtaatgtagggaagcagagatcagattatcttctgggggatagtggaggagggttgtaaccaccccaagtccttgagtgaggatggaacctagggctcaacagcagaaccctaagaacggatatttttgcctaggcctaagaatgtcatcagcattttatttatttgtttgtttgtttattgagacaaggtctgcctctgtcacccaggctggagtgcagtggcgaagtcttggatcactgcaacctccacttccctggctcaagtgatcctcccacctcagcctcctgagtagctgggactacaggcacacaccaccacacctggatatagttttttttttagagatgaggccttctacattgcccagtttggtctcaaattcctgagatcaagcaatccccccaccttggctcctcaaagtgctgggattacaggtgcgagccaccgtgcccagcctcatcagcatttttagacagctacccctctgtggtactctgtggtgagaaataagtttaagagataagtatgcagttatgaggaaaggtgatagaaccacaccatttttatgaataatatactaaaatatattcttaaaaaacttgtcagttgtatatttgataatagcatatttttacttagtccttattaaagatctcgggaaattcaaatctgtttcatctttgatcaggagagaagatgttgcccatccttagcccagagttagaaaggagaaatcatgtgattggccaaggtggtgatgagagtctcttcagaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaccatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaattggcatcttacgattcagcagactaacccaagaaataattttatggaataatcatatttcaatatcttatttcttttcaaaggaacatttaaaagcttataaaactaggtataacaatgaagctgtaaaagaaagtaagaaaacacaatcaaagttaaaatgaaccaagctaaaaggtaaatataattattggtgttaggctccatatttgcctacaggcttcctaatattcagagcaaaatggaaaacaaactgttatcctagctcaggtcacagatcgctctggccattcccttttatctgccctgtgtgctttcttgggctcttcttctgttaacaggactctttttttctttggggaggttcttctccaccctctgcctagggctgtcaatcaatgtgccccatcttctacccttctgcataggacccccattcccttgacatggtgattttccagaggatgggtacctaggtacctggccaataagagttcgagatcaataagagtcttcccagaggttaatacatatgctttggaatggagtttattgcccactaaagatgctaagctggaaaaatataaattggggctatccattggctaaattccctgccctgaggagcaggcctgtctccagtgggaggaagaaaactgaacagaggagaattgcaaatggagagagagcaagccctgtgtactgagttctggcttctgtccctgaggccctgaaacctggctgctgcagcttttgattctgaccatgatccaagagtccttccaagcagtgagagcaagtaaattccattctttgattagcaagtctgagtagaactctgccacttaaaacaaaaaaagtccaaattaatacatctttcattattggaaaggaatcagaatatcagtttaacaaggagcccattttattttctaaaattaattttgaaagaattttctcacatgggacttaatagcgcatattgactgatgtaatggacaatgccctcaaccacatttttacagtaaatgcagaagcgaatttcatctgatggtttctagtataaaccttgaataaaagccaagggcataacattaaagcaaaattgagttaaagccattttggaagaattagcccagtgcacatagagtgttcaacatttgagtggctcaattcacccaagaaagcttcaagaagttgaaggacactttttaactttgacagctttcttcatgtgttcctttgtttccccatttacccaaacttctgataaaggttgaataacaagtattttgagattctaattttcaaccagagctaacattttccactactaagtgagaaagggatctaaatgcttcagagactgggggaaattagaggagagcaaagttatgctacttgtatctaaatataagaccacttgtctctgcacagaattgacccctgtgggacctttggggatacctgcaagatatgcaggctgtttttttctatcaataaaccttggattttcaacaacacaaaaacacatcatcaattagatccccagagtcatgaaccaaaacagttttcacatgaaatttattcaaagtaaggatttgtagttacctgttgtgatatgggaaaaccacacagcagcttggcttccagtgtgctttccagagtgaattagttttaaagtgtttattttctttattccctcctccccaatttcacccagtatctgaaccaatgtatccatcaaagtagtgtaatcagagagtctgcctagaaatgtattttagttaatcatggctaataccaagcccttctttctcccagaaatcaggatgatgtccctcttggaattacttttgatttgtgactggttttgatcatgattacacttccagtacctggcgtaatacctagaacaaactcccagtaaatatttgccaaactaatgatagaatcagatttatattttgaaatgagcactctgaatatattctagaaattgtattggatgaacacaaaagtagagtgggaatgcagatgaaaggctctgtgcccacccagaggagggccgcttgtggcttaattcaggcagcaataatgggaactgagagaattgagctggtttgagagatatttaggaggtcagttggtgttatgaaaagataagggagaaagaaggaacaaggccagctagacatgttgtggggcccagtgggaaatgaaaatgctgagtctctcattaaaaaatcattaggaatttcaagagggtaatagtagagcaccaaactgtgcattgtacaggacttttactcataaagccagctctaagaataaaacatcctatattcattatgcccggggcgcttccatttactcactgagtgcctaccatgacagccactgtggtaggtacttaattctacctaaaagcaataatacaggattaggatagaagcccaaatgaagaagaaaccaaacatagctccaatttatagcacctaagagcattttcacctgtaaggaattttttctatttttacaggaaagatcaagggatttgccctgattcttggagtacttaagtgcaaattttgaagcatttcaattgttgaaaacatatcttttttttatatactttaagttttagggtacatgtgcacaacgtgcaggttagttacatatttatacatgtgccatgttggtgtgcttcacccagtaactcgtcatttaatattaggtatatctccaaatgctatccctcccccgtcccccaaccccacaacaggccccagagtgtgttgttccccttcctgtatccatgtgttctcattgttcaattcccacctatgagtgagaaaatgcggtgtttggctttttgtccttgtgatagtttgctgagaatgatggtttccagtttcatccatgtccctacaaaggacatgaactcatcattttttttggctgcatagtattccatggtgtatatgtgccacattttcttaatccggtctatcattgttggacatttgggttggttccaagtctttgctattgtgaatagtgccgcaataaacatatctttttttaaaacttagcatatatctatttgccatctcctgggtcaaaaagccaatggaaagctcaatgaaatctccaaatattcttaggttcaccttgacagatttttttctgaagagcaaaagagactataaaaaaacacttatcaaacatgagagattatgccttaaaaccacttaactcttatttaagatactactctgaaatatgtagatctgaaaacagggaagattaaaactcattttgctaatgagggcttagcccttgaggactccctgggtaaaattgtattatgggcattatctgggtccacactctgccctcaataacaagagaataaaactctcctctggtcataggtggagaattagcagcaccttgacattttgaaagaactagtctatcaaaatatataacagggttgtgacaaaagaatgaatggaaaaatcctctggtaggggtaattgcatatgattgatataacaaattatgattcagcatttactgagctcctacaggatgccatccattgtgtcagatccttctgcatgtgcactgagttaaattctcactgtaagattgacatagaccttatcactgaagatattaacaaatcctatcagttgagggaaattcaggttatgagaggtaaagtggtttatccagggttgtgtagctggttattggcagagccagaacttgaagctcgatcaactccacctataggtcaatactgtcctaagatttctggatacaagtttctgtattttcaaggacttcgttcatgggatttccccgtatcatgaatacctctctcttctgaatcatccctaatgcttgtagacatgttccaatatccctcaccttcaaaaacaaaaagaagatgaaacaaaaccttcttccttactgcactgctgttctcatttgctctgctccctttcacagacctacttcttaaaaaggcatttgtcatcaccatctccactttctcacccaaatttatttattacctttttgcttctatctccacattgccaaattcagtcacttttctgttcttattttattatgtctctggcagtatccaacaaagttggccattctctcctgcttgaaatactttttttaataatatattttgtcatctataacaccatatatcctcggtcttcctcttacaatccttttcggttttcctcttaccatctcctcgtagattcttcttctggaatacttttgccagttcttctgtctttgcttaacgaataaatgtagagtgtttctggaaatctttttctatatgctctttttaggtgacccctccagttgcttggccacctgtgtgagccatgtatctatgactctcaagcatagtctctcccctggacttcagacttgaccacccaacacccaaccaccaccttgaaatccccacttggatgtccagaagatttctcaaacttcacactaataaaacagagtcctagatttctctcctccaatcctggtccacctcccctgtgcttctacatctcagtaaacattaccactctccacttaagaaccttaagacagaaatctgaattattcctttttacttcctcatcaccatactaactcaatcagtatgccctattgcctctacctgtgaaacatctaagtccgttcactttttaaaacattttttaagttttttgttaatgcataataaatgtccatagttttggggtacatgtgataatttaagacattcatctaatttgtaaagataaagtcagtgtacttgggatatccatcaccttttaaaagtatttgtctttttataagctagaaacattcaaattattcttttccagctatgttgaaatgtacaatagattattgtaaactatagtcaccctactgatccatgtaacgctagatcttatttcttctatcaaactgtatatttgtacccgttagtcaacttctcttcatggtcacttttatacatatccatttctttcacccaagttaaagttactatcctatcctgcccgggctacacatggtctcctaacttcaacctcattggtctctttcgatttcttaaatataccaagcagattctttccagcttggtgcctccaaggtaactgtttcctctacctggaacactcttcccttgatccttgcatgatttgctttgtcttgtcattccatgaaaataacttttactctgaaaagccttagccaagcccctaaagtagccccacagtcacatccactctcctgagcacttgttaccatctgattatgtttgttggcttgttcgtttgctgactgtttggaatataagcttcacgagggcagctgtgtaccctgttcaatgggacatcctcaacacggaggcagggcctggtacagcacagtcctcaataaatacttgataacaaaataaataatttatgttgcattttggaataataattatattcttagttacacattagctgtatctagaagactgataatactgggggaccaaattaccttttaaaattatatttaagcctactaaacaacaacttctgagttaacaatattaagacaaataaagaatgacatggctcacaattataaatcagctatggttaaagatactcttaaatagtaaaaaataatcaagaaaatgttatggatttggcctctcaaattatgaccctgttgaactatacaaaatataaacaaagaacaatatctgaaacattattgaaatttactttataactgaaagttagtataagcagttaaaactgaaagtaaatatagacaaaataattgaacatatttgacaaaatatagacatctaaaagtgaaaagcattttaaaagtgagaaaactcctagagagtttgaactattatatggtattttcacctttagattatgaatagcatgaatgagatgataacaatggtaataacaataaattcactataagttcttagaatttagaagataccattctagaagctttccatgaattatctcattaactattactgcagtcttatgaagtgagtattatgatcatttctaatcttatgcatgacaattgagatttaaagagtataactttccaaggtgacaaatttagcaggtgtcagaatccagttctgtcagaagaaataagtagaaaataaaggtgggtttgttggcgactagataatcataataaacattgatataatcgtttataatttttcataaccgtagaaattatacaacctgtgtaaagccaaaatactttggtgatttctgggttcagaagataatgccttttgtagctatggagcttagatcttgtagctatatgtgtttgactgagggaagtggaaattctctaactgggatatcataccaggatgatgaattacctgtgcaaactctcactattgcaaggtcctatctacctggaaatataagattaaggtttgcaaatccacttgggtaagtgtgtctcaagattttaacctatttacttataataattttcgtatttgccacctaagttttatacacaagactaccaaggaatagacataagttgcaagtggtcacagcttgacctgaaaacctatatcagtaaaccagtggagctctccttagaacagtaaggaaaagaagtgtaagatatgacttcagctgatacagtcagcaaatacttcttggatctatctgtcccatacactggtccaggccctggaaattgagcagaggtcaaataacccacttccctcatgaaacttacattgatggaatgaactactttttatatatttaaaataaaaataatatgaaaacttgaggtaatgaatgctgggcacagtggctcacacctgtaatctcagcactttggaagactgaggcaggaggatcatttgaggccgggagtttgagatcagcctgggcaatgtagcaagatttcgtccctactaaaaaaaaaaaaaaaaattagatgggcatggtggcacatgcctgtagtcacagctactcaggaggctgaggtggaaggattccttgagcccaggattggaggctgcagtgagctatgatggcattactgcattccagccttggtgatagagcaagaccctgtctctaaaagacaacaacaaaaacttcaggtaaaagtaaacctttctttcctttcatgtcagagaccacatattgcaatgagagtgaaatcacatgaaacttataaataaaactgcccttctatcagaatgaaagaaaggacaggaacaggtcaacttggttattttctctctagacccgtcattgagggtagccaccagagggctacctagccatacctaggtcacatacctaagtaacctgatacaaaactttctcctacctcctcctttttcccacctgtgaacctaacaccctgaaatttagcatctagaagtatctaaatgaagacagacatataatttttgcccctgagctcccacccttttggactggaattggacatatctctggagccacaaatcagagtcacatagatgtgactgccagcttttgtgacttggactcagtatctttttactgcgccaccttacgtttcactcagacaccatctggtgatggattggtccgtcatgcggtatcagtctgcagaatcatcttcagtactttaaggacagtgcagactagaggaaagattccaggttagatgtcagctatttgccaattagatgacctgggtatgtaatgagaatgcatagccccacttcgtctggtaaattgggactgtaattcttactttgtcttagcccacaggatgatatgtatagaaagtgagttataaactgtaaatgaagctgggcacagtggctcacacttgtaatcccagcattttgggaggccaaggagggaggatcacttgagcccaggagtttaagatcagactaggcaacatagggagaacttgtctctagaataaaatagaaaaacatagccaggagtggtggtatgtacctatagtctcagcaacttgggaagctgagctgggaagatagcttgaggggaggagttcaaggctgcagtgagttgtgattgcaccactacactccagcccgggtgacagagcaagaccctgtctcaaaagacaataatattataaataaataaataaacaaactgtaaatggtacaaatataaaagagcaatactaacgacaaataataatacatataatgaatgcattgataatgacagtgaaagttagaagtgattcttttagcacagagataagagattagctcatggctcaggccaggcctcacagattatctgtctcctggtgggactaatgcaagatctgaagtttggtctgtaactttgtcattttggtttgttctatggaccaaactctggagtactgattaacatcattgtctagcagttgaaagctctctgataaccttggggagtgctagatagaatagatacaattttgccttttgattttcctttgcccaaacaagtggttcacatatgaagatgtcttttggaagggaaaaataaaaattacagattcccatgtaatagggaaactgagtcttaaaatccaacaccaccatcttatttctaagtcgtttttacattagggcttgttataaacctaggttattttgttttgcctacgtgtaaatcttgatggattcaaaaattccccaagtaacttagtgagatttcaaaaagatccttgattttagcagcgtttttataaaactgtcagttacagtagataacaatagcaattctattctcctccattttaaactggaatttactgattcaaatttttaagagaaaaagttcctgaacttgtccccttattctaggggaaaccattttggtgcctgtctatagctacttatggcctctctctcttgttttttgagacggagtctcgctctgtcacccaggctggagtgcggtggcaagatctctgctcactgcaagctccgcctcccaggtgcatgccattctcctgcctcagcctcccgagtagctgggactacaggcgcccgtcaccatgcccggctaatttttttttttctctatttttagtagagacagggtttcaccatgttagccaggatcgtctcggtctcctgactcgtgatccacccgccttggcctcccaaagtgctgggattacaggcgtgagccaccgcgcctggctggcctctcttttttgaatgaggtaaaaaagaagcttgagaggcaaaacaaccaacagcaaataaccctagtgtattcattcattctcacactgccataaagaaatcctggagactgggtaatttataaataaaagaggtttaaatggctcatggttctgcaggctgtataggaagtacagtggcgtctgcttggtttctggggaggcctagggaaatttacaatcatggcggaaggcaaaggaggagaaggcacgtcttacatggtaggaacagaagcaagaaagagagccaggaggtgctacacacttttacaagaatttactcaccgtcacaacagtaccaagggggatggtgttaaaccagtcaagagaaaccacccctatgatccatcacctcccaccaggccccatcttcaacactgggaattacaatagaacatgggatttcggtggggacacagatccaagccatatcacctagtaatcatcctcaccttcagttaaagcagcctgtgtgtttactgaagaaattagctacttgacaccaatcttttcagcaatactgctgtcagataagagaatcattgagtaaaatgccattaattgcaaataataaaacgtcattcattcaaatcacgtaatgagaagtttgaattctgtctccaaaaccaacccttacttttgtttatttatttttacctagtacccagggcatgattctgtctatgctgtcataggtctttagattttagttgccattagcaggcattttcattcaatttatttatttatttagagacagagtctcactctgttgctcaggctggaatgccgtggtgcagtcatggctcactgcagcctcaaactactggcctcaagcaatcctcctgcctcagcctcccaaatctgtggaactgcatgcatgtgccaccacatctggccctggaatatgattttataagaaagctgtctctctattaaagttttatgcaaagaggaaaactaaatcagtggacagagctaagagttagacgacccagactttcctccctccgttgcctctgtttctgtctttgcaaaataaggaaatttgactagcttatctttaaaacctctacttgctcattctatgatggtgccttgagatggagattcagtgagagattcttgtttcagtgcttttatatatttaacaaattttcaccgagtacctattacgtgtcaggacctgctctaggaaatgtggatacaacaatggacaaaacggacaaacctatgtcctcatgtagtttacattctaaggcctataaagtattgtctatttgaacacataaaatgtattctcccagtttgggcagaaacaggacttctgcaaggcctggagaagtaaggaagactgaagcaaatggaatccatggcactttccaattttgtactttctctttctgtctctccttactttcatttcttgacctactcctagacccatgcagataccaaattttacaaattttactaccagcaaatagttatctattatgcagttaaactgtgctatgtgtagggatgcagagcaaatcaagacatagcatatgccttcaagaagccaatgatgtccttgtgagaacaaaactcacatatgtaaaaaaaaattgctagttcaaaatgtcagaggctgagaaccaggaatatggcctgaacagttgtgtgctctatcaggagagattcactaaaagttagtagacttcaggaataattttcagtgcacataaagcttgaacttaagtaacataggtagttttcagattttaaaagcaattttcagtaaatacaagtagagatatggcctgcaaaataagagtaggatatagcaagacacatttcttattcttctgacaaggtagtacacagttcatcactttattgacaagatttattgatgtgactattgtgatgtcatcaacaatggctttgaagttcagaacatgagaaagagctaatggtagggactgacttgaaagcctttgcattctaagaatgatgattaggtttctaatgtattattaaataatgtccagcccacaaaaaagatgaagtctgcaaaggtatacacaataactctgtgccttgctatggtcctatctgatctcaaacaagaagctctttgggttgtgttgctggtggttggatgtgttctgagccatagctaggcttatgcacataacaaagtctgattcccaggaatctttttaggaaacacctcccagattaagtaatatttacctacttgtcctctttgaacagtgctcctactgattctttaccctaatgaagttcatgtcccaacccacacccttttcctaaaacaattaagcttttagtggtgacatgatgaaaaagaaaaaaaaaaaatagatgcaatggctgacttttggaaagttcccagcaaaaaaaaatcccggtggctttctgagtctcagcatgtttcttcttagttctgtgtacactgagataaaagtagagtgggagactgagtttaccacctgtgctaaagcagcagctgttagcattggtgacattcattgttacatggatatcaattgagctgggattaggaagccgcctgtctcctcaagcttgttacgattcagtcacttggaaaaaaacaaaaacagactttcggatgaggattctaatgcccaggtgacctgaaagccaggttcagcgtagtcaatgagcaacatgaaatgaaatttccaatcagaattctcattagccttattcagcactacccagatggatgttccttttgatgtctttgtcatagcagcctcacctatgcaaatattgccagtattaccccttatagtaagttgaagaacttttaagggttgtgaactttacataggtaagtgaatcaagtatacttgaagagcctctctgttgacataagtaattagattattggacaaagatctgatctagtaattttcttagtatgtatgtgtgccaaagccaagagaggatatgttattaattagcaagcaaaatttctaacgtaggggttttcccacatcttaagtaaaattctcgaaacctggaactatggctggctctctggaggtgtttcataaatgcttgctgaattaatgaatgtatccacaggcatcttttaagtggctacaatgacattaagaagaaataaggtcacagagtgtagttgccgcctcaggctctgggaaggatgggtctggaaacaaccccacagtagaccatacacattgtttttgagactttcagctcatccatttggttactgattacaagacggtttttttttttcgtctcaaaaaatgctttatttctcagaatcccatttcagcattattggtttttccctcaccaattctattttcagctttctgccttttctcataatgacctgtaggtgataaattagtaataataaaaatcaataaaaaatgataaagttttttttgggggggaaataggaatgagtttcatgttaagaaaagaaggaacgttccagatggaattttctgtaatgttaaatgtacccatatggcttctgggaaatttaggggcatccttttgtattagggtaacctaatgccacctgctttaaaaattcatattaggaaatagccacattttgaccttcttgaacgatgttcctttatcaatcaaaaatataaagggtgttttatttattagtcattgttgaaatccgtaatctctttctatcgccaaattgtcttaaaacgtctgtccagcacatcattgcaaccttgactgtcccttccactgtgtgttgaagagtcacaggtcccagggggagctgcgaagaaacgtaaaccaaataccatttcagtaactgttaagggacaattgtgacgattttgtaatgcttggcatgttttgcttataatcttgtcctacaaagaagcctatcagcagagatgagagatttttgctatgcaaagattagattaatattgatatttgcagaactgggttcaacctgtgggagacctagtcgcaggtcttgtagaatttatagcatattaagaagatatttaaatatttggcttcagtgtgatggcctcatttctacatacctttctaatatgtgccaactctctcttcttcatttcacttgtccgctgaaagatgagtcatcaagtctggttgaacctatctaatatctcttgaatcagtatgtctctgcatctgtattgccatcaccctagttctggccatcctcactgaccacctgactttctgcctaaatggtctcctactttctggtcttgtatactttcaaccctttctctgcaatcagagtgatattgcttccaatgttgtacagacaattcttacaaggtcctgcagcttttctttcagtctttctttctttttttttttttttttttgaaatggagtctcactctgtcacccaggttggagtgcagtggcgcgatctcagctcactgcaacctctgcctcccaggtttaaacgattttcgttcctcagccttccaataactggggttacaggtgcatgccaccatgcccagccaatttttgtatttttagtagaaagagggtttcaccatgttggccaaactggtctcaaactcctgacttcaagtgatctgtccaccttggcctcccaaagtgctgggattacaggcgtgagccactacacccagctctttcagtcttactgttcgtcatttttttccctcccctttctgcaccctcttcactctgctttcccattctctatgcctgggctacatcttaaaagacgccatgttctcctggggtctctggtgtccctgattctggaaatgctttcctgtctcttctctctaacccatttcacttagataagtcctatttatccttgagatttctcataggtggcagtctttttcccataagacttttcctgttctagacctggtggctcacacctgtgatcctagcactttgggaggcacagccagggcgaatgaacccaggtgtttgataccaacctgggcaacatagtgagactccatctctacaaaaaataaacaaccaggcgtggtgatgagcacctgtagtccaggcatggtggtgagcacctttagtcccagctactcaggagcctgaggtgggaggattgcttgagcctgggaggtcaagacttcagtgagccgtgatcatgccactgcattccagcctgggcaacagagcgagaccctgtcttaaaaaaaaaaaaaaaaagaagaagaagaagaaaagaaaaactttccctgatatatttaggttgagactagacaccctcttatctgctcccacaatgcccacgtcctccatcactgtactgaccatactctggtaattggctgtttatctgtccaatgccttccctagaccagaagctcctaaaggacagagcctgtattcccattcgtagtaccagcgttcagcacagtagctggacctgactaagcaccaagtaaatatttgttgaattaagaaaattaaaaaaaaagtgagaagtcaacagtctcttaatcaattgtaaagaaacactttactaggatgttctgacagctactccaaagtatcaaatattttaagtgaaattgtgatgtctggtgacattttttcaatattttagatttcttacacacaacttattttattttcatccactgaagctctcaagcatcttgttaaaataaaataaattagcttggtttctgtatgtgtgtgtgtgtccttttttggggggaggggggctggtggcaggacagggtctcactttgttgcccaggctggagtgcagtggcaggatcatggctcactgcagcctctacctcctgggctcaagtaatcctcccacctcagcctccctaatagctgggattacaggcatgcaccaccatgctcaggtagggttttttaaatttttcatagagacaggttcttgtcatgttgcccagtctggaatatatatatttttttgacttttattttaggttcagtgatacaagtgctggtttgttatatagataaactcatgtcacggggatctgttgtgcagattgttttgtcactcaggtactaagcccagtacccaatacttactttttcttttcctctctccaccctgaccctccacgcccagatagacaccagggtctgctgttcttgtccttgtgtccatgtgttctcatcatgtagctcccacttaaaagtgagaatatgtggtatttggttttccattcctgtgctagttcactgagaatgatggcctctaactccatccatgttcctagaaaggacatgatctcgttcttttttatggctgcatagtattccatgctgtatatgtaccatattttctttatccagtccaccactgatgggcatttaggttgattcctatatattttttaattgacaaaaataataacccacagaatcactaagtaggggaaagatcagctgctgatattttggatgtacttttctcgagtccaaaggataattcagtcaacttaaaatagttatttaaaaatgtgaacagaatttgtggatgttgagacagattcacagatccttaggaaatattaaaacttttgaaaaatggccacaggctctgaaggaaaagagcagttgggcacttaatgccacaagttactcttataaatcattatgctaatgatagaactgaggtggttcatttgggaaaaaaattgaaataacatttaggaaaagctgagaggctggcgatcaccattatgaagagagcagcctgcactatgattagatgccaccaataaggggaccatatataactgaaggatgactttaggagtcattgtaaacctgtcttctgacagcagcttgagacaggaattgcattcttcctctaaatccttttaatttagtaaagccctttattgaaacatttacaagcaaatgtaaacttttaaggattcttacatcccataaaagcagtaattttggcatatagctcatcaacatgaaatgagtaaaaacatgggaaggcagtactttttgaatgttgtatgccatttggcaaatctacatgttcctcccttttttcgcatctccatgttcctcctaaatgaaggagttgttgttgatgttggtttactttaatatgtccaattataccattatcatctatttatcaaaatagtgccatttaattgccttttgctttaagctgtattttatatgaaagattcctagtgttatttctgtcctttggaatattatccagcagagggaattttaggatctacttgataatacagatttgctaatttccacgttagtacttcagtgttgtttagttacacagtttcgggcctcatgatgtgtttgatgatttgggagtgataaaatgagtcttaagtaaaaatcttttaattaaaacaaacaaaggatcagtttttatgggaaaccagtcagtcagcaagtacatgtgttttaagtccagaaggatgctcaagtggaggggtagagagagagagcccttgggatccagggattgtagagtaactgctcccattatgccaggcctagcagggctgtcccactgtctctgccctcacactgaccacttcattactggttgtttttactgagcatcttttcagagatttctgagaacatggtaattttcccagaccatacacctgagagatcaggtactatgttgcctttaaaaacaacaacaacaacaacaaaaacctttatatttttcctctttttatggtgaaatatggcatactttattatttggagaaagacagaaaacatggtttttttctcccacaggccacaaaataccatcttcctcttacagggaatgagacttttgtataaagaggcacaatttcctgtcccactaggagaaaattattctcttgtctgagtctcaacagaagcttgtgttagttgctgttataaattaaactactactcaacccagcagtcccattactgggtatatatccaaaggaatataactgttctaccataaaaacacacgcatgcttatgttcattgcagcactgttcacaatctaaaagacatgaaatcaacctaaatgcccatcaacagtaaacaggataaagaaaatgtggtacatatataccatggaatactatgcagccataaaaagaacaaatttatgtcctttacaggaacatggatggagctggaggccattatccttagcaaactaatgcaggaacagaaaaccaaatactgcatgttctcacttacaaatgggagctaaatgacgagaatacatggacacatagaggcaaacaagagacactggggcctattgagggtggagggtgggaggagggagaggatcagaaaaaataactgttgggtactaggcttagtacctggatgatgaagtggtctgtacaacaaacccccatggcacaagtttacctatataacaaacctgcacatgtacccatgaacctaaaataaaagtttaaataaataaataaacttggtctccagtgttaaatatgatatgtcatcatcctcatttccttcatccagctattttatattcctcccatctgctctgtcctaatatttatattctgtaggccttatcgtgcatctcttattccttctaaatatgttttactctgcctggttcctccactcttttggctcttgttttcctacttcctttaatgtaacagtaacacagtgagcacttaatagcagtctagaataaactctgtgttcctgctttaatctatatctggtctttatctctcacctttatctttacctctgtcactgtgtggacttacactgaaaacagaactataccatgcccccatctccatgctgagtagctggtttataaatcaggagagacaatgctctttagatattcttaaatttgttataattctttcctgttatccagctcctcaacctcccttcccagctctgtctaccactttgtatcacttaagccacgttttatctacgtcttctctgtcactaacctttagtcccttgaaacaggcacaaccaaacaggactgacattttgcaagtcccttgagattttgcctaatccttcacagcaacctacaaagtcaatctggggctggtggaaattctcctctttcagccttttccttcttttggaatttgggggtgttttcacagagtgatttaccaagaaaacattctaaatcctcaaggatcacttatcccttacctcgtggttgtttgctcgagaccaagcacaactggacatttttgaacttacgtctttctccctaccctctttgttctccttctcccccttcataaaatctgacttcagtttggccttcaagtgagattgacttttagccccttccatttggcaaatccttcaacaaaaaaacagaagtgtcatttttacggggtgacaaagcattaagaagatcgctttttcagccttgctgtgcttcattataggtaagtcctcatgtggcaccttttacaagaggaagtattgtcatgctaacaaaatggtttcagatagtatgaaatcagtggtgagaagaatggctataaggaatgggctctacaattactgtcactctcagcaaaagagaacgcaaggaatgcatatttcatctcatggcgacctgaggatcgtcctcaattccatatgtaatactttctaaataatggtgacctttttcacgtccccttcctgtatatacaaagtactatgtggataatgcagcctgagtgagcttatgagctaatgcagggatttttattattaacaataatcatagtgaacaacagtttattcatgtaagatcaagcaactagtaagtggtagaaccaggactgggtcatagggtaggtacatgtgtaccacttttaaatattgccaaactactttgcaaagtattgaattattttacattcccaacagcagtgtctgggaattacaataatccttatcatgcaatgactggcgtattcattctttttaatttttgacattctaatctgtgtgtagtgccatctcattgtagtttgaatttgcatttcgctagtgactaatgatattgagcatcttttcatgagcttatttgcatatgtatgtcttctttgctaaagtgtctatgcaaatcttttgcccatttattaggttgtttgttttcttatattgagttataactttttttttttttacatattctgcaaacatttttaaccagatatgtagtttacaagtgtgttttcccagtctgtttcttacctttacattcccttaccagtatcttttgcaggaaagatgttaaatctgttgaagtgtagtttatcaagttttttctttggattgtgcttttggtcttgtagctaagaaaactttgcccaaacaagataacaaggattttctcctatttttttctaggcatgttatggttttaggttttacctttatgtctatgatccattttacattaatttttatatatggtgcaagttatggatcaaagtttagttacatgtggatatccaagcatcctaagcatcttttgcccaaaagataatcttttttatactgagttacctttgctgctttgttaaaaataaattgactatgtgtaagtctatttctggtatctctattctgttctattgatctatatatacttatccttaaaccagtaacacgctgtcatcatgactttagctttataataaatcttgaagtctggtaaattaagtcccccaatgtttttctttttagacattttttttggctactgcaggttctgtgtattttcagaggacttttaaaatcaacctgtcaatttctaataccaaaataaagttctttagaattttgattgggattctcacgaatgtgaagatcaacttggagaaagctaacaacttaatattgagtcttatctctcaacttattttggttctttaaaacttctttcaacaattgtttttcacatagagatcttgtatatattttgtcagagttcgcccaaatggtacatttatttatctatttatttagagatggagttttgttcttgttgcccaggctggaatgcaatagcacaatctcagctcactgcaacctccacctcccaggctgaagcgattctcctgcctcagcctcccaagtagctgggattacaggtgccagccaccacacccggttcattttgtatttttaatagcaatggggtttcactatgttggttaggctagtgttgaactcctgacctcaggtggtccacctccctcggcctcccaaagtactgggattacaggcatgagccactgtgcctggcccaaatagtacatatttttgatgctattattaatgacattgttttattaatttatatttcaagttgtttatttctattacagagctttctctactatgctgacatccatctgaggtctcttctcaacagaattgcctttaatgtccacatttctaccaagcttctcttcaaggaaatctatattttttctattactcaccttaaaattcttgtagcctctatccatttcccaattccgaagccatttctacatctttaggtgtttgttagaggagtaccccactttctcgcatcaaagtctgtatcagtcagtgtttgacagagaacagaaccaataggagatggataaataggtaggtaggcagattagtaggtagatagatagataggtagatagatacatagatagataatctatagatatctaatgcctggaaagctaatttttctatatattttctctattattttagttgtttcagatagaaggacaaattggatccctgttactctatcttgaccagagtgaaaatctgattaacttttaatcctcagtctcctcatttgtaaaatgaaaataataataaaatctatttcatgaggttattgggatgttagttttgttaatatgtataaaaacttggtgccttgtacataataaatactcaataaatgtatttaaattttgaacaacatatttgacatattgtgatttccaagtatctatactcttttatgtttgttaatgttatatatggaggcaatctgacttaacatcaaaaaaaaaaaaaagaccattcataagatgtagtcagtaccagtaaatgagagcacattttcctctaattgggtgtgtggatattggttttcaccctacttggagtttctgactatttgtcctagtgaccatcactatattcatttataatattattaaaatcaatggatgagtcattggttaccatgtgtattccggttctgaaacacaccctcctcttccccagccagcactcacctcagtgatacccagtctattgcaggttttttatgcattttctaaattacatgaaagcaagttgacattctttctttgtcttagtcttccataccattattttggcatgtttaaagtatcatccatctgattatgtttggaaataaaagcatgaatttgttaaagacatgtaccttccaaactgcacacttattgtgttttcactttcttatcattgtcccttcattagagaaaaaaatctattctgtgaagtatttggttttttatgcagtctgctctgctctaatatacacaaacacctgattctgcaatgagaattagttggtatgtgattgttgagcagggaaatagtactatttcacagaatttcctttagtttatatatggatttttcttggctgaagaagccagattactggagtaaaattataatctccagcaaaaataaaaaaagaaaagtccacagctcagcccctcctctaaagagttgtacagcgcagccttccacggctcatagcttacagcaggtctcccttccctgccaccaccctcacagcaaccccactggctgagcactctgtttttatttattgtctgagcactcatcagtgcagctctgtttaacatgttacctgtatttccacccaaattttttttttttttttttaagaccaggtctcactctgttacccaggctggagtgcaatggtgcaatcttggctcactgcaacccctgcctcccaggttcgagcgattttcctgcctcagcctcccgagtagctgggattacaagtgcccgccattatgcccatctgatctttgtatttttggtagagacagggttttgccatgttggtcaggctggtcttgaacccctgacctcagatggtccacccacctcagccttccaaagtgctgggattaattacaggtgtgagacactgcacccagcctctaatattttttagaacatccattgtggtagcctcctgccatgctgaacagttggcctgggtggtgcaagttatctcccaattattgggaggtatcaattatcatttttgtttggactttacaaagttttataggttctaagtgatatatcccttctgcagtttttctcataagttctgtttatacagtatgtgattttgcagaatatgagttttttgagattatatatattgcaatatcatagaaacctttttgtttgataatctttgcttaaaataacctcatttattttgtacgaatgtacaaaaataaaacaatgtagtacttattggctgtttttgtggactgaggtagagatgtcaagaagttcaagccaaaaaaactgaaaatagttaacagaaacaggcaaatctcatatatcttgccctgattattttttcattagagtccctcctattgaggaaggttcattagcatgtgatgaaacacattgagggggattaattaggaaatataaaagagtctcaaacttctgatataaggtaaaacacgttaattttatgtgtctttaaaaatgtaattagaaccttctgtttgtcttttctgagacacgtatttaaaatttccctcgactcaactgataatctgtgattttgattttcatcccaaagtgacttttaaaaaagttttggggttagggggatgtggtggctcacgcctgtaatcctaggactttgggaggccaaggcggggcagagggcggcagatcacctgaggtcaggagttcgaggccagcgtggccaatattacaaaaccccttctctactaaaaatacaaaaactagccaggtgtggtggcaagtgcctgtaatcccagctacttgggaggctgaggtaggagaatcacttgaaccccagggcaaaggtattagtcagcagagattgctccactgcactccagcctgtgcaacagagagagactttgtctcaaaagaaaagttttgggtgaaaagtagaaaaaaagtcataactttgtgtagagacttttccctcctgtaattctttttattatcaaatatcaggtattatagggtataagccagtgttcttttttatgatttccagaagtgttaaattttccatgtcttctgcatttgaaagtaataggtttggaaagagaaaagctgttcattcttcaagtacatgtaagtttaagtaccttgcagactttgttttgcaggaagcttccttgccttctccccatatcacctctctgcacctcttcacacccatgagggtctttatagcagtgcagtccataaattgttttgaggtaccaataccagtttcttggatattttcttacttaggaacataaatacttaggctgccattgcgttaataaggaaatgctggatagtcagaatcctacattaacccgagcctaaaatctgtagtatcgcttcaaatatctatgtagaaagcatagtttattaaactaaacatctcctgtaatcccagcactttgggaggccaatgtgggtgaatcacttgaggtcaggagtttgagaccagcctggccaacgtggcaaactctgtctctaccaaaaatacaaaaattagccaggtgtggtggtgcaaccctatagtctgagctacttgggaggctgatcacttaatttaaaacttaaaagacctaatatccagaatctataaggcacttaaacagattcacaagcaacaaacaaacccattacaaactgggcaaacgacacgaacagacacttttcaagagaagatatacacatggccaataagcatatggaaaattacccaatatcactgatcatcagagagatgcaaatcaaatccacaatgagataccatttcacgccagtcagaatggttattattaaaaggtcaaaaaataacagatgctgacagagtaaagggaacgctcatacactgctggtgggactgtaaatcagttcagccgttctggaaagcagcatggcgattcctcaaagaacttaaaatagaattatcatccaatccagcaatcccattactgggtatgtacacaaaggaatacaaattgttctatcatgaagacacctgtacacatatgttcatcatagatagcactgtccgcaatagcaaagatatggaatcagcctaaatgcccatcaacagtagattgaataaagaaaatgtggtacatatacaccatggaatactatgcagccataaaaatgaatgggatcatgtcctttgcaggaacatggatggagctggaggccattatcctaagcggactaacacaggaacagaagagtaaatactgcatattctcactcataagtgggaactaaacaatgagaacctatggatacatggaggggaacgacagacactggggcctacttgagggtggagggtgggaggagggagaagatcagaaaatatacctatagggtactatgcttattacctgggcgatgaaataacctgtacaccaaagccccatgacacgcagcttaccaatataacaaaccagcacatgtacccctgaacctaaaatacaagttaaaaaataaatacataaaaatttaaaaataaaaaataaaactgcaaacgtgccctgctttctggcagtaccccattccctgttccttagttttctctctggcacttatcatttatctattttattcattgtctgtctcccttcactagaggttcatgagggcaaggattttcatgttctgtccactgctatgtccctaacacttaaaaaaaggctttgcattctatagtcattcgatgaaataggctgaatttagctaaaagggagttcatgtcctttgaagaaacatggatggagctggaggccattatccttagcaaatgaacacaggaacagaaaacaaaataccacatgccctcacttatcagtgggagctaaacaaagaaaacacatggacacaaagagaagaacaacagacactggggtctgctgagggcagaaggtgggaggagggagaagatcagaaaaactacctatcaggtactatgcttcatacctgggttacaaaataatctgtacgtcaaatgcctgtgacacaagggtacctgtataacaaacctgcatatgtacccctgaacctaaaataaaagttgtttgtttggtttttttgtttgtttgtttgttttgagacagagtcttgttcttgttgcccaggctggagtgcagtggcgcgatcttggttcactgcaacctctgcctccttggttcaagcaattctccctgcctcagtcacccgagtacctgggacaacaggcgcctaccacaacgccaggctaatttttgtattttttagtacagatggggttttgccatgttggccaggcttgtctcaaactcctaacctgaggtgatctgcccacctcggcctcccgaagtgctgggattacagttgtgagccaccacgcctggcctaaaagtttttttaaaaagagaaaacactttccttaccctttgtagctcattgtctatctaacacaccctgtcactctcatcagccttgaacttcttacaaagccattcaataaaatgaaaggaaataggtgcagtgggccccctctgattcgtggctttgatttctttggtttcatttatccacagtctaaaaatattaaatggaaaatttaaaaaaaaaacaattcataagtgttaaattgcatgccattctgagtagcgtgatgaaatcttgccctgtcccactctgtcccatgcgggacatgaattcttcccctttgtccagcagttcctcactgtctatgcctccgacctgttagtcactcagtagccctctcagttattagatcgaccatggcagtatgggggtgcttgtgttgaagtcacccttattttacttcctaatggcctcaaagcacaggagtagcaatgctggagatttggagctgccaaagagaagccctaaagtgcttcctttgagtgaaaactcttaataaggaaagaaaaacattgaatgctgaagttgttagatcttctatctgttgaactgtgaagaagaaaaaagatatttgtgcatagtatataaagggtttcgtactacccacggtttcaggcatccactgggtgtcatggaatgtatcccctgaggataaggggggattactctatgtattttcgtatccttacatcacttacattatttttcctcagccttgttgaggaaaataaaaacacagaagccaagaaagaaatgagcaagcactggccgggcacagtggctcacacctgtaatcccagcactttgggaggccaagacgggtggatcacccaaggtcaggagttcaagaccagcctgggcaagatggtgaaacgccgtctctactaaaaatataaaaattagccaggcacagtggcaggtgcctgtaatcgcagctacttgggaagctgaggcagagaattgcttgaacctggaaggcagaaaagttgcagtgagccgagatcatgccactgcactccagcctgggcgacagagcgacactctgtctcaaaaaaaaaaaaaaaaaaaagaaagaaaaaagaaatgagcaagcactgaacacctactgtgtgcaaggcacttgatagccttcctgttatttcttcctcactacaatcccatgaagtagttcttatccccattttacaagatacaaaaattgactctcaaaaagcttaagaaatttgcttctagttgcacagtcttatagattttcacttttataagataaaagagcttattcaaatccaagtctgtttgaacctgacaaggaaagccttctctaaatagagtatctgaatccctccctgctcgaaagtctcctttatacgctcatgtttcaaaaatttcacattttttgagatatagatagtacccacccacatcacctctgtttttatggaaaatttacacttaagtggcaattattttaatcagatcgacatcctagagagtgagagttcattgaggaaagaaggaaggtacatttttggatcataatgaggagagatcttgatatttttgaaatttgttttgtcttcccatggtacaaagttttaaaagtacaaaaatatgaacagtaaattctcccttctctcccatccctgtctctagccacccactcctcttctgaggcaagagcagattctgttgccaccttcccaagcaggtagtgcctttaaaaaacaaaaaacaaatgttcacctactatatgcattaccatgcaccttacacttttcatttaataaatataccccagcaatggtgatagcagattttggaccagcagtggggataaagaaggtcctggtcacctaggtgcctaaagagaagcagatgaagagagaagaccctggagaaatgttttcctgttttgcacctgcaggtgcttgacatgcctctgaaaatgatctcagtgctgtgcagttccacagctgcagtggtacccacaatgccaaaacttgggatgcaaaggggcgggggtaatgacaaaaatcagggaaggaggaaccatagcaaccacctgatctgcacactcatgtattttatatacctctcttcaatgcctagtgtccttagacagtaagctccctgaagacacaggctatgcctactttattcatcatcgtgtcttcagtgcctagcaccctgcttggtatgcattcggttcatgaatatatgagggaacctgctgctgctgttcagcattcacacctccatttcaaccccatcagaacctttttcatgcttcctcttttgtagtgtctcagaaactcattctgttttcttcttcatctttttttttttttttttttaatggagtcttgctctgtggcctaggctggggtgcagtggcatgatctcagctcagtgcaacctccacctcctgagttcaagcaattctcctgcctcagcctccctagtaactggggctacaggcttgcaccaccacacccagctaatttttatacttttagtagagacagggtttcaccatggtggccaggcttgtcttgaactcctaatgtcaagtgatccacctgccttggccttccaaagtgctgggattacagatgtgagccactgtgcccagccttcatcttcatcttaaaacttcttccatgttcgctgtggctggggacatgatattcctctttccctcccagttgctcctaaggatgagcaaaaagctcttttcacgtcaggggttgtaccgccaatcactaaaaggaacagttgaaatatcaaacatggagaaattgcagtgattacaaaggaatgcaatggggcaccatacagatctgaatttgccagtttgccatatccaggctgtccctgttgcctctggtccaccttaagctaggtgcaaacccagttggaggaaagaaaggaagttatgtgttctctcttcaaggaagaaaccagataccagcctcaaactcttgttcttaggtcacttctttccttggtccatttcactcctcactctccattcaattaaaggacttgcagattaggttatttgcaagtatttctgtaatttattctcctactcccatttgaagccaccaagcctgtttaatattaaataagcaaatgcttcaagtactatggtgacttcttctgtgcctttgcaactaaagccttccaacagcagaggggagaaatttatatctgttatatacatagatgagtaatttgggaatataaaacaaatatccttcttagaaatatttaaacacagatgcttgattttgtctgatctttctctctcttttttttctctccaaacaactggttacccacacttgtacagtcatgtagagacaaaatgctcatttataattccagataccccatgtaattattgcctatgataatcaggtaatctttatgaaactattcctatacaattttcaaatctcagtttacaatcatgagtattttaccataatcttcataatgccctcttgaatatatttgcttaatatcattttgaatttagtgatatttaagttaacatattttatatgttttcatttcattagtaggcttttaaaaatttacttttttgtgagaatctgatttttgtgagactctgtgaacaaatatcctcactaattctttctaatggtataatgtgaatttgtcattgacaagtgttacaaaaaagacgcatagaaaataaaatattttaggtaatcctaagatagctcttccgcagccagggcaattgggctatgtgtctttgggttgattgttagctctgtcctaaatctctgaatttggagaaggaaaccctggatttgaattccagttcctcaacttactggctccatgttcattccttctttgtcaagccccctaacttccctaaacttcagtgccctcatcttaaatataatgacataatagtgtctctcataagattggtagaattacatgggataattcatcttgcatggtcaggggcacggtctcgggaaccagactgtgtgggtttgagctgctcagtcttggacaaaagattaaatatatctatgcctttgttttatcatctataaaatgggaataaccatagtaccttattcaaaggttgttgtgaagattaaaataaattaatcctgtaaaaatgcttaggtttctggcacatagtaagggcttagtaaaaactaggtatttttacctggtatgtgcaagcactgtatatatcctgatatactttctcatctataattctgtttctgtgcactagtttatatatttatttaatggaattatttttacagatttagtcagattttagaacacaaagcaagtggatacttagtagccataggggaatctgattttgatgtctcctacccaaagtttattcatatttaatattatatatacataagtcttattctttctcttcgtcctttttttttaaaggcaagatctgccttcatcttcggttttctttagtgcttagaagattgccttgctagtgataagtatttttgcttaataagtatatcttgactgtgaaatttgtcaccagttttgaaaggaactctggcagcaaatgaacaaacttaaatccttgtggccagggatcaaaggcaatctcaaaccgaattctataataaagagaagtttggagagagaaagggagtttagtgtaaactcaacttttgaaatccaaaggtatcaggctatcatgggaagagtgtgggattcagctttagccctggggtcacaaagtcatgggtatgctcttatataagtaacttaatcagatctctgtttcctcatctgtaatattaattcccttctcctatttcatagaaatgcttaaaatttttaacagaggtaatatatgggaaaatgctttgtaagctataaaattagtgtacaaatattagggtcactgatactctgtgacgcaattcaatgatttggtagaagactatatatatatgtgtgtgtgtatatatatattatatatatatatatatattatatatatatatatatatatatattatatatatatatggccaaccatatatctattagtagctctctctatatatgttttaaagccaggctggtcttaatcttgtctattgaattcattttgacaagaacagtgtaggatccattagtcctttacaatgaagaacatattaggtgagtcaatacttaattccaaaattttactttagaataagagggatgtctaacatcaattgattgaaggctggaggaaagagcgtggagagaaagaagtaacacactgctctgtgtttttgtgcctctgtctccagaataaaagtggacatgcccttcttcctccttacctctctctctctgtatccctttcagtacatatgtccaacactgccatacacagcctcgctgaaagtatcaggcaaagggagaaacagtgagcattcctacctccagccttgacaacaactatgaagtgtgttgctctaagctctgatcataagggaattagaagcactatgattttttaaaatcaaaatatgcctgtagctccaaaaaagaagaatttgactatagggtctcagctcactgctaggagaggtgtaactgattaaactctggtgcagaatgtatcaggatggaaggaatctgagaagtcaccaagttcaaatccttactttcagtccacagagtcatcctgctgcatttcctttttatgcctgcaaacaaaatgtttctggaactcatttattgtcagtgagtgctccctgggctctgaagcccagagatgttcctccataactcatcagaggcttgggtcatttctgagacaataagttactgctaggtcactgaacatacttggggtaggcagtggggaaggggattctgtgataagaaggtgatcatgtgttctctatttataggaaaatgaatcattctcagggtgatgagcatgtgtcattaaactgttttcctgatcatgaccttgcaccaagctgtttgccctctttgccctgttccctcaggctcagtggtcagggagggtgggccagctggccgagatgtgcagtccagtccagagttcaagaacagtttgaactgtgagactgagagccaagctgactaggtcagagtgagaagccattcctcagcatatgggagctgttagttagtgccctgaagctctctagttatttggggaaggaatgggagaaagcacttagatccctgctgggctcattacctttaattagcttgcttggtctggtggctactgcagagggggaaatctccaaaaactgcaaaaagattgtgcatgatggtgggggaagatactttaagaagggaagaagactctgttgagcttccacaaagaacaggttgttcatacctgaatgcacacagggaatgcacaaattttataaacaagaaggctgggtttgttttttttaagtttttctgtttttaaatttctgtttatttagcgggtacaagtgcagttttgttacatggatataactctggtctttcagtgtaaccatcactcaaatagtgtaccttgtacctattacgtaacttgtcattcctcaccctcctcccaccctcccatctttctgagtctccaatgtctattattccaccctctatgtccatgtgtactcattatttagttcttacttataagtaagaacatgcaatatttgactttctgtttctgagttatttcacttaagataatagccttcaggtccatccatgttgctgcaaaagacatgaattgattcttttgtatggctgagtagtattccatggtgtatatacgttacattttcttgattcaatcatccattgattgaatggtgtcctttgacttatcaaataaatggtgctaggaaaattggctagccatatgcagaacaatgaaactcgttcccctatctctcaccatatgcaaaaattcactcaagatgaattaaagatttaaatgtaatacctgacactataaaaatcctacaagaaaatttagaaaaaactcttctgggcattgcctagggaaggaattcattactaagaccccaaaagcaagcaaatgcaacaaaagcaaaaataggcaaatgggacttcattaaactaaaaggctttggcacagcaaaagatataatcaacaaagttaacactcaacatacaggatgggtgaaaatacttgcaaagtacacatccaatgaagggctgatatctagatatctagaacctatgaagctgtttttaagaacagaatgaggacatgagccaacacccaggattccagtggaaagtgaacagagcaggcacagttaatggaaaatgaacagagcaggtacagttaatggaaagtgaacagagcaggtacagttaacgtcatactttacctttttccatttgcacttcacgaagagatgagctttgatagttaacttctctctctttttctctctgttttcttcttgtgcaaactgggtgatgacattgactctcttcacaggaaagcactaagtgaggattaactaggtaatgagagcaaattggaagggtgatggagatgctccgcaaccttgctgatggatttctcccagcgagagaatctcttcaatgcatctttcatctgtgtcttacaggcagggtgtaccatcgttatctctgcattctgcttaagccatcccctccaaaccctgcctctaaggagctttggcctattccttgaaaggattcttcagttatcccaccaacaatcagaggcagcaggactcaatatccccctgtatggagaaaaactgagacaggagattgggctaagttgtcagtgattcacccccattcctgccctaaggaaaggatctttttctttccttttttttttttttttttttttgagacatggtctccttctgtcacctagactggagtgcagtggcatcatcatatctcactgcagcctctacctcccaggctcaggcagtcctcccaccttggcctcctgagtagctgggactacaggtacatgccaccatgcccagctaatttttgcattttttgtagagacagggtctcagcatgttccccaggctgggctcaagcgatctaccctgctcagcctcccaaagtgatgggattacaggtgtgagtcaccatggcaggccaaaagcatcttctcaaaaatctttcttccaaaatgtatattatacaaactttctggagaacaatttaggaaaataagtattcaaaattcttagaaaggtgcatgattcttgcccactgaattccactttcagcacatgaccattagtctttcatttcttcttctcttcttcacaccagagtgtattgccttcaacaaagaaactaaccacttttagacttgtaattaacctgtcccttcccctcatctgcccacctgactactgaaagtccccagagtctgcttcttagtgggacaccagccttctgcaaggcacttattctctggttatgaacctgtttaaggaaatctatatatttgcacagaaccatggaaatatagatgtgaacaggcttaagtgatcacaacccacattttttttttttttttgagatggagccttgctctgttgccaggctggagtgcagtggcgcaatctcggttcactgcaacctccacctcctgggttcaagcgattctcctgcctcagcctcccaagcagctaggactacaggcacgcaccaccatgcccagctaatttttgtgtttgtagtagagacagggtttcaccaagttgaccaggatggtctcgatctggtgacctcttgatctgcccacctcagccccccaaagtgctgagattactggcatgagccaccacgcccagccagcccacactttttatcagatgaggaactagagactctgagaagacaggtggcttatccaagagttcatacttattcaaggctacagaataaaccagaatctggggcctgtaactcccatatgggcccttctcgagttatggagacttaacggtgtgggacacaaaataggaagaagtagagtaaaactttataaagtaggaaaagaaataatgtttgtactatgtataatggcacttcaaaatccaccattaggagtgtctacagtttcctctgcataatttagaggctgaggccatgtacctcaattcagtccagttttctatccaagaggtgcaagctctaaaataaaggaaaggaatattctttatcagtcatcagcttaatctcaaaatattgtgtgctccataattgaccttcattagggcattatggacaggggcttactatatgctaagctatgtaaatacagatgctcctcagcttataatggggttgtctggataaatccattgtaagttgatccacacataaccctattaaaagtcaaagagcatactgaatgtgtattgcatttgcaccattctaaaatcaatgtgtcccttgtgtaaaatcagttgcatccgaaaagcctgaaacgtgtacatattctttgatctagccatcttattctaaaaatcaaaataaaatcaaaataaaatcaaaatataggtaagttgaactgtcataagttggggaccatgcgtactctgatagtcagtgttatgtatgaacttgaccaagccgcagggtcccagacatttgtccagccattaatcaggtgtgtctgtgggaatgtttctggatgagatgaacatttgaactggtagattgagaaaagcagattcgtctcccctatgtcagtggacctcatccaatcaagaccggaatagaacaaaaaggctgagtaagagggaactactcctgtctgactgctttgagctgggacatcaatcttctggccttcaagctcaaatgcaaatatcagctcttcttgagtcttgaggctactggttttcagactagaatttataccattggctctcctggttctcaggccttcagatttagactgaaactacactatcagcattcctgagtctccaaattgctgactgcagatcttatgactttccagtcattccattccttgtcataactctctttctctttctttctctctctctcctctctctctctctctctctctacatatatatatatatatatatatatatatacatatatatatatatatatatatgaacagatacatcctattggttctgtttctctggagaaccctgactaatatacagttatgtgtcacttaacaataggatatattccaaaaatgtgtcattaggcaatttcatgatttgtgaatatcatagaatattcttacacaaacctggatggtttgctgcacacctaacctgatgcacactgaggctttatgggatagcttgttgctcccagactagaaacctgtacagcatattactgtactgaatactggaggcaatttctaacacaatgacaagtatttgtgtctctaaacatagaaaaacacagtaaaaatatggtattataatcttatgggaccagttgtatatgtggtgtgtcagtaaccaaaatgtcattatgcagcatatgactgtatatatacatttacacttaatcctcacaaaaaccctctgaaataggtactattgttttgattatcaacctaactttaaaactgggaaattatacatagactggttaagttcctcgcccaaagctacacactgcatctggaaggagtctgaattcacccagataccgcgtgctccatctgtttgattcacattctcctaattgtgtcccaaaagcctgaaacatgtgcatattctttgatctagccatcttatcctaagaatttaccctaagtaataatcatggatgtattcaaatatatcgcaaaacatttataacagtaaaaatatctaaacaacttaaatgctaaacaataataggcgattggttaaatgttctatgatgtagttactcagtgaaatactaccttcattacaaaccatgccctcaaggactatttatttacttgggtaatcattcaagctatatagatgagagtaaaaggcctgttacaagcctgaggagagatggtaactaaatatactgtatgctcgatgagaccctgaaattacattttaccatgtttccttaggcttgtagcattccatttttacttctattctgaagcagaaaaaggagattagataaaaactaagaaaaccttaataaaggccgggcgcagtggctcacgcctgtaatctcagcgctgggattacacacatccctgtttttaaaagtgaaatctgccttctatagaacacattcccccacagaaatatactacagaaaacagacctaataaagtggagttttgttcaaatgcttccctcacaatgatgctttaatttgctgaggaacatatgattgatcctagttcacctgctgaacatgcataggcagtgtgcatctctagcacactgattaaaatgaatacccagaggctcaacatgatttcttattaatcagaacatacacaactttgtgaaagggaccttagagccattctctgccccagggtgaactgggacacaggtatagaaacctccaggactctgttggaagagtttttcttctaggttttttttttttttctgttataactgtcctttccaagattaaatgatgcctaggatatcacatcgttcagaagaggttgaaagagggagttatttataaatcctgaaggttctaggaggtttgggcttagaccactttggactcagagaaggctgtgaggtaaggcatgttctaatcttgttgatggaagtcctaatgtgtcttagaagatttctggtcatcactgtctttagggactcagagtcttcctctaagttagtttcaggaccctttgaagtattggcattgctggctcagtccactggctctttggccttcacctgtctgcattatggttatagctgagatgccaggaaaaacacaagatgagtctgttcagctcgaagctgactcaactggtttctaccacctcaattcaaactaggaatgagatatttttcttcctttgctttttagggcaattaatgttcccacatatctccctttttcttgccatttcttagcatcctaaacactaattttgcaaaataatgttgtaaatgctttgcatagtcactatcttatgttgcccttcctgttcacaagacagccgtccgtgtcagttgaagatttctatagatatgcatcatctctgatagataaaggcatgtttcagagactatcctggtgggagtattttacttttgaaaccaactaaatctggttttgctcctgtttgtggtactttatttctccctgtagcaggagagtagtgccaacgtgcctggaaaatcaagtttcaaacctctattgcattttaagccatgttttagaatcttagggtcaattaatattagagttcgacaaaatctctgctctcaaacaaaattatatacaaaagctcagtaagtaaaccaggtaaatgttaaggtgcttcggttgaatctaggtttaggagtccagagaatctaactcaaacctggcagctggaggatacccaagaaactccctgggcttagtagtgtacagtgcgaaaaacagcgatctcatccatgtccttcattttagggagatgatacctaaactttgtgggttttatttcaaagtcacatgttaattagtggcattgtgagggaagcatttgaacaaaactccactttattagatctattttctgtagtgtatttctgtgggggaatgtgttctatagaaggcaggtttcacttttaaaaacagggatgtgtataatcccagcactttgggaggccgaggcaggtggatcacctgaggtcaggagttcaagaacagcctggccaacatgatgaaaccccgtctctattaaaaatacaaaaattagccaggtgtggtggcacgtgcctgtagtcccagctacttgggaggctgaggcaggagaattgcttgaacccggaggtggaggtttcagagcaagactctgtctcaaaaaaaaaaaaaaagaaagaaagaaaaagaaaaaggatgtgaaaggaaagagtttgcaaaaaaaaaaaatgcggcaatcacaatacatttatgtctattcatattatttgaatttgtcattttcttcagtgattttttttccttgggttgttcttatttctacatcattatgtttattatatgaaggaagcagtcagcctcatgtttattctctggtagagaagaggaaaacagtaatttttgagcatgaatgcataagaccatacagtttatggaaatggctgtagcttctctaacctttcccctttcatacatacttgtttccatgtacacttcattccccctttttccccctttaactctctttgtatttgtatccctccttccctatgccctttttactcaattcattccctacatcacaacctgtggtttttgtatctgatcatagttttcaccctattgaaaatcatggctggccaagtacatgttaacaggaaaattctggacagtccctttgtacacaaaccttactgcttagtttcatctgtgcagattgctgtatactcagccctgcagcagagagaccacactgcagcctttagtaggaaaaggataggaatgacaatacactgcagacactttcgtgagtaagttgctaaagcgtcagtaaaacatcatggtgaggcctctgcaatcagcctgcttagatttaaatgacaattctgtcacttacaaatatataaccatttggatagttatgtttgcactttaagcctcatgttagttatctggaatagtatataatattacctacctttagtgtcatcataagaattaaatgatttttgtgatataaagtgttaagtgtggtgccagaccctggcaaagttggtaattgtccccttccttccttccccgctttcaccttccttcctccctccctccctcccttccttccttaattccttctgtccttccctcccttcctcctttcacctccttcccttccttccttctttccttctgtctctttcacatgccttctttctctcttcccttccttccttcccctcaccattctatgagggcataactgggagggttaatagaatggatatctaaagcagcgattctcgaatataggcttttaaccagcagaatcagcattacttgacccgaaaacttgttagaaatgcaaacacttaagtctcacccctaagctcctgattcagaaaatctagggttagggtttaactgtctgtgttttccttgtttttgtttgtttgtttgttttgtcgttgttgtttgttttttgtggttgttttgttttgtttttgagacagggtctggctgtgttgcccaggctagagttcagtggcacaatctcagctcactgcagcctcaacctcctgggctcaagcgatcctcctacaacagcctctgaagtcgttgggaccacaggtgcaccaccacgcttggctaatttttgtatttttggtagagacagggtttttccatgttgcccaggctggtcttgaactcctgagctcaagcaatcctcccaccttggcctcccaaagtgctgagatacaggcatgaagtcactgtgcttggcgttttaaccagcctgccagatgattctgaatttgaatatcctggtgagaggttttaaatcatgcaagtggctgtctgcctccagttaaggtaaaaagggaaaggcctcagcttacactgtggttgagccatatgacaggacatacaaacactattaatattactagagaagcaaccagcaccgttttgaatagctcagtctattgggggtgtgccttctactcaagatgtaaataaggataggaaaaatagcactagtatcaactgccatacaattatttagtcacccttgggtaactaaacagcataggtatgttgatcaaaatgcccttgagtaattgtcagtggaattttgaactctccccaattcaataagatactgctgcaggtattggtgaggtacagggagcatctaaatggactgtctttcattgtctttcttgagggttctaattctttggttttctggagaatattataggatagaatgtatatcagaagtgagacttgggagacctgtgtgacctcccaagcatgacaatattcacagatattcagatccatagaacacttcaggaaattgtctttatgttcaaagatctcatagaacatttagttggatacacttcccacacacatctctccatttgatatagagtcattatcttttcaaactttctttttggtcttttacagaagaacctgttaggatattctcaagatttgttctagtcacacgggggtggagggggagggggggtgtgttatagaagtagctctagatcatttagcttaagagttaaattttttgcaaaaatactttgtggtggatttctgatgccagtccgcataggacttttattattgtaatagtgttttgtctttcttttttaagattaggaaagtatattcaccataatatttgttgttaatcacttattttttatgcaccttttccaaagcaactatattgtccttatcttgaaaaatgaaaataatagcttccagataaatccttatgatagttttgctatcactagatagtggcagagggaaacagaggaaaaggagatctatgcattgtctttgaaagtcaagattattatactaaatgtttttgaagcattttgaaaatacagcgatatttacttataattctcaactatattacagttactggatctaaatgagaagtttgttcatctgtaaagtatttgaatgctaatggtattcttctagtctagtgcattcaattaaaatataacgtgtgttacatatgaagttaaaaatgtttagtaaccaaattaaaaaggtaaagagaaataagtgaagttaattttaataatatattatctttaacctcttttaataatatactctctttaactctttaatatatttaataatatattctcttttatatacatagaacattgtcatttcaacatgtaatcaatataaaaaatatcaattagatattttacattctttttttcacattaagtctttgaaatttagcacgtattttacacttacagtacatcttaatttggactagatgcatttcaggttcccaatagccatatgtgtctattggcgttcgtatcatatttatcatggcagttttaaatgtattaaaatgataagtctataaggtatcttcttaagtaaattctcccaagtataacagatatcagaggtaatatacacctacaaataattattgctaaagtaaaatttgtaaagctattgactgtcagtaaatatgtttaagaaacagtttttcgtattactctaagattgttcttaaaaccagcattgcagttcagtagacaagtgcagatatttgaaataagatgtttttatactacctatgtttaaatttcatgagcttcatccagcactggattttctggattctgagatatgctattcacatttcaacatttatgaaaacagaatacatcttacaattaatgtgttcatttaatgtaatcatacttcttgttttcctgaaactgagttggaaatcatcatggaaaataggttcttctcaacacaggaagagttctcagctattgtatagttgtgtttttgagaacatgcttcagcacttgagagatggatttcctagagtttttcttaaggatcaaaattaaaaggtggaaatatacaaacgctaaataatggaattaagcattggccttggataacagaaggtgaaggagataagagacaactttctgttccagctccactttaaccacaggggacataaatatatgggaccttgtagtatttaaccttgttaatatctccatactgttttgcagtaggcgttggaacagagcttcacatttttctggtggaggagccagtgatctctggatggtgaaaatattctctaaaacagactccacaactacaatgaccagtacaatgtgttttctatgccgctgtcctctgtcaaggggcatcacaagtggctggcctatattcatgtaaaggtagaactagaccccaatcaatgtgccctataaatacccaagtctttaaatacccttagataataaaggtaaaagatgcaagaaaaagaggactgggagagtgggccaagtttatagttctttcaaagtctatttgaattatttaaaaccattctttttttgttaatagattttaattctcatacatgtcacatgtttcttttgcagaattcaaaacatttttaaaaacacccatttcaataatattgcatgcaaggtaaacaagaggttagaataactagtacaacataacgcagcttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagttggtcaatggcatcagagaacttaaagtgcctgatgctgatgactcttccagaaggcaatcctcttatgagggtcagggtctagagagtccacgttgctgctcgtactctctgtgtttaattccagctaacatgacaaagtgcaagcgtatgacaaggactttcagtgtgaccatcagctggaagaagccaagtgcgtacagctcccggtggggtggcacatgctcctcttgtgacttaatggtggcttgtggctccacttcccttgggggttgtttttgttgttcttctctcaggaccacatttattttgatgttttaaaagagaaagaaaagttccaaaaacttcctttctcgtatttcctctttgagatccagcaaaatttctacaactggccttttccagatggcttgcccagaattgctgagagtttgaggcacctcaagctctgggctcaacatcgaaggttctttaaatgtgccttttatcctttagtttctgtcacttgatgatgggtgaccaccctcatctctctctctctctctctcttttttttttttcctactaaacatgagattactggaaatatttcatgattggatacatgctattggttaatccatttaaccaaactcccatcaatggatgtggagtgtttacaacatttttgctctcataacagtgcttgacaatgtagggatttgtcaggttttaatccaaatagggctttatgatacttgccattatactatcagatactttttcccactgatatggtttggctgtatgtctccacccaaatctcaccttgagttgtagtcctcataatccccatgtgtcaagggcgggaccaggttgaggtaattgaatcatgggagcagttttccctcatgctgttcctatgatagtgagtgagttctcaggagatctgatggttttataaggggcttcccccttcacttggcactcactctgtcctgccccttgtgaagagggtgcctgcttctcctttgccttctgccatgattgcaagtttcctaaggcctccccagcagtgtgaaactgtgagtcaattaaacctcttttctttataaattacccagtctcaggtatttcttcatagcagtgtgagaacagactaatacactcatcttttgaatacattatgtgaagtacaacaattttttccaaaccaaaccagacctggctaaatcctttactatagaccccaagattgagagagagggaaaaaggaattgatctgaatcaaatttgctgttatcaagaagtagggtagggaagggaccaatatgagatgtacgaaaattggctcccaaagtacagaaaaataaagatttgacttgcctactcctggcataccatttgtaggttctggccaacatctgcccttctctgagcctggagcttctctctttcaaatgggagataattgctgggcagctagagctcacaggcacgccgcatgatgagtgaggtcatgttaataaagccctgggaaagaaaagcaatgtgaaacagcagggctattaccgttccaagacgattttatacaagtgaagcttaagttcagtgtgatgattaacaagctattagagccaagttattgattcctctatctttagagtagctaatgcagtgtgcaccaataggccacagaccccaagctttccttcttcctgtgctcctgttctttgtaatgatgctttccttaggaaaatgaaaatcacttcgcatacacagtgcaacatctttaaggcaggtgccagcagagaggaaaaacacctaagctgattttgtgtgtttttattattttttctgataataaagattaatgcagatacatgaaaaaaacaaaacataaaaagtaggaacagaaagtcaaatactgcatcttctcacttataaataggagctaaataatgtgtacagacaggcataacagaacggaacaatagacactggagacttggaagggtgggtgagtgagcagggttgagggatgaaaaattaccttagaggtacagtgtacattatgtggatgatgatttcactaaaaccccagacctcatcactatgcaatatatccacataacagaactgcacttatacccataaacttatatttaagaaaagaaatagaaaaaagataatttttttaaagtagaaagagggaaaaaagtaaagcatcatcccaatttctttcaccctgaagcagctagttttgctaatatgatcatatacctatccacacatatgtatatgatcatattaaacatattagtttataacttgttctttgttccttttctaacatactcctcacaaaataatatcattgatagtttcccatttcaattaaaacagatatcaatataatttatcagcaaaatattttatggatgtgtgtacagttttggttaatccatttaaccaaaatcctcttgatgaacacagagtatttacaacatttttgctctcataacaatgctctgatgaacctcatgcattcatctttgagcttttgaccaattttccttctgtggtaaattcctgaaagtagaattgttgggacaaaagatttagagattttgtatctttaaacatattaccagtttgccaacccaaagggtcatatgagattactttctgcctacagtgtagtaaagtgccagcttctcccaacaaccttgccaacgttgggtattgtcaattttttggctctttgccaagctgataggagaatggaatgtctaatggtttttgaattacattctgactgtgctgcatcagactgtaactgaatgcagttgtgatgtatcaggggacctggtttaactcagcacactgtttgaatctgtgtaataactaactatgatataatcaggctttcttgcagttttgaaaaagaagccaaactttcacatggtttaaattactctctcatttacactctccatgtgtgagatcacctgggaagccctttggagatgcccccagtgacccagtacaagttgtcaactgcactccccatgaaagagagattgttctggtccaaaccctatgctctagaggagcatcttggaaacagcactgccctataattgatattgctccattgggtggcctgtggtattcaattcactggaaagtatcaatccctttgccttcagcaataatattttcacagttttgatgtgttttaaaggttattgtctccaggacaggtaattgaggaggcctcacacttcatcagaggccatttcatctttattacacagccacacacaaggcagcattttctcctttcactgatggattatttcaagatttataaggtctggtctacatgaaagcaaacacatgtttgggtacacagtcaaataattcaaagatatagggtcagcaggatcctaatattaaagtcaggacttccagcctgggcaacaaagtgaaatcttgtctctacaaaaaatacaaaaaattagccgggcatggtggctctcgccagtggtcccagctacccgagaagctaaggtgggaggattgcttgagccccaggaagtggaggctgcagtgagccatgttcatgccagtgcactccagtctgggccacaaagcaagaccttgtctcaaaaaatgataataataaataataaaagtcacaactttttcctcttctacctgtgccagagacccactacctaacccacatacacacagacacacacaaacacaccatacacttattcctttcttaaaatgtggctttcaaatatttgctttgcatgcagttttctctgaagatatgaccagtttcaagattatctactctaagttttctgactggttgtcagtcagtcagtttggaaccctgccataacatattttcctcaaattccttgcagatactggaataataatgaatgggaatgttattttgagccgatatttggaaagtccttatttggaattctacaagtttatgtctcctgcccagttcctaagccctctttctagataaccatccagaagataatcatccagcagctatccgggtacattcggctgacttggttagttgggtctaagcagtatatccatgagttctaactcgggtttctcaaactctttttcctttgggtttctcagactcttctctcaaactcaaactgccttctccagtccattgctaaagcttgtatgacctttgctttccctccatttcttgacttgtggcatccactagtcctacattgtaggactagtgtgagcaggtcactcagcctgaaagcactcaccctgggcctctagagctaagttgcctcaacacacttcactatggcttctcagagcacactcaccttgaatgtttagaaaaggtaatctttttggggttcaatgagatcaaaagcacggataccaattttgggatcaggaatcaggaaaatctgggaaatgaagaacgaaatgaggccttaccattttgatacaaagttcatattcaagtgagtcaggagatctggtttaagttccagatctgcctcttactagttttagaatcttgggcaattctaggctggacgtggtggctcacacccataatcccagcaatttgggaggccaaggcaggtgaatgcttgagcccagaagttcaagacatgccttggcaacataggaaggccccatttctacaaaaataaaaattagccaggcatggtggtgcattcctgtaatcccagcaatatggaaggtgggaagatcacttgagtccaagaggtcaaggctgcggtgagctatgatctgccactgcactccagcctgggtgagagtgagatcctctgttaaaacaaaacagaacaaaacaaacaacaaacaaacaaacaaaaaaacaaaaaaaattggagggaatttagttcatatatttgagtctttgtttcctcatctagaagatgtagtaaagataaatgaggtcatatatgattgtccctggcataatattttggtacttattgaaaagcagctattgttttaagtcctttgcatatacatttctatgatttactatatatcagtagcatttctccaacccatcttggctaggcaagcaccactgaatatgaaggaggccaaatagaatgatactatccaagctgcaaagaaacaaacaaaagaaaacatctaaatgcatgcctctttggaatggcatttgcatccgttgccaatatccatagaacaaatgccttcaggcaggagaagttgggataatgtcaatgtttttaatagctgtagtagagtcctatttagaaagcagtaattatctctccatattgattttttacatcccctcaataaatccagaagaaatgtgaagaccatctgtaagtgtgatttttaccaggatcagactctaatttgcaatggctatgtgtctgtttgatttagatcaggggttagcaaactgcagcccacaagccaaaactacctcccccatctatttttataaataaagttttattggaacacacccatcacacccatttctttatatctgtggctgctttcatgctaccatggttgttttatttaattgtaacagagatctaagagatctagagcccatattgcccacagagctgaaaacatatgtacatctaaccctttgcaggaaaaaacttgttaaatcatgattgagattatagtagtattatttctgattgactaggtagtaattggtcccagcatgtaaagtttctaatattaaagtcacacgatagaggagctagaggcttaagaaaagtatacatgaatttatttatttggaataggaagggaaacatccctggtatcatcatgatggcatatagaggcagggctgagagctagaatacagaatacgtcctttgctagaaacagtttctcgggctgggttagagtgggtagaaactatggatcatcctgccgcaggtccaagtaaacaggatttggcgctctacataatggctataaagaaacataaaggtgatttctccaagtgttatgctaggtgagaaatatttaataagtaagagcaatcagaattggtcccatattgagaaagtctgttttggagcccagactaaatagactgtgcagtgagaaatgaaaggtcaatttaggtaacttcatttagggcaaaatcatgacttaggaaatcatgactagataaatatccagtgaagagcagggagagaagattcatcaatggccgtaggttgctgtgaactacagaactgaaacatcaatgtatgaataaagtgctgtattgatggacagatgtgtgcatttttatgtatatgccataaaaaatctgaatcaatttctatttgaaatagagaaaagctagttcagatgttagaaacttttctgacgcaaaatattgtgtaattcataaacaattccttgtgttttagtttacagtatgtccagaatataggacttgcctactgtaatgtataaaacaaaagaacttcaggttgatttatttgttaagtagtagacattctcctaggatgtttatgtttgtgaagatgataaatggaagaatacatccacagaaaatgtagacacaggcccttctctcccagtctcaacaccacaccctacacacacacaatgccttccttctaaccttgtctatactgtctctgcaacacacaaagcatatgcccaggataagcttctctttcaaccacctatcaggctttcaacatgtggtttgaaaagatagtgacattgctatgctctgacatacaccgtaatgtcagtacagcagaagcaagtggaagattctacttttccgataaagatcagttgctgtttcctgtcttgaagacgaaagttgagcaaaagcaaaggtcatctgtgtttatattaacaatgtaagagttatactacattttcgcaacaacatcaggtcattatttatccacttgtcctttttttttttatcattcctttgaactgcctgcatttgcttatcgtgatatttctcagtctgtaaacagcccgagtagctgttctatttctctaaatagagtcttaggtcattttattatccagaattgtaagtcatcagaatgcacccatctgttgtccttccacatctgggctaactttaactctttaagcccatagaaaaagtagaaaagccattgtgatatgagtttgatacttttttcctaccatactgctttccagcatatggttttccctgaaaaatcacaaggaaatatttacaaatatcttatttttctttggacatggcattaaacgtggtagatcctccatctccacttggctctttctgattttctgttaccctaattatccttcctgcgatcacagctgctcagagcctcttcttaccaatttaaaaaacctctaaagatgtgacggctgcctttccagtggccaacaagcagatttccatagcagaggagctgcgactggggcagagagccaaagacagcttgtgccaacagccttgtcaatatgccaatcatcttgttacagtttattacatgcgtgacttgattttcttgcatgtgcgttttagaggtaacaacatattggtaaacctgttttcaatccttttgattaccttcaatttgatagctccttcagtaatgaagaaaaaaatgggctattgtgtttgaattacatttatcaaatgattctaagattgttctaacgtgtgcgacaggataagctctcttttagtcaccaattggagaaatatgctcagtgtcaaggaaatggagaaatgcctcattatttatgttgactaatgtataaatacaatatgaacaggggcggtttcaaccctgcaaacgttttcttccaagttgctctgtattttagctagactagactagattgttcagtggtcacaaactaccccaaaatcttaacagtttacaacaacggaagtttattttctaaatatataacatccactgagtgttggccagcgttgactgggggttgttctccacatcacgtccctaagggaccaacagtgttggaggagtctctcttctcatattgatgttcaccatggcaaaggcaatgatcacagtgaaccacatgctacattttaagcttctacctggacaccacacaagtcacttccactcccatttcggtggtaaagcaagtcaattcaagtctgacttcagcatctttgggaaatataattccaccccaggaggggaagcagatatgggtgaaatgtaataaaattcacctctccataaagtcctagtagcattgttttatttgagtgaattctttttttttttttcttccttacagatcctctttaaaacatcagcctggaaacagtatctgtagaaatcagttttgttagttctaaagcagggcttcattgttgggatgtgttgtctgccttcgttagcagatttcaatcatagccctaaatggaagacacattttagggctgttgctgctatagaactccaggtctttctgcttaacggtttcacacttacgtgtgaagggaggacacccttggccaaaagaaccaaggctgctcagttagctgctggttgtcctccagcaaattcctagaactaaatacctggtgctgaggtgtcacgactcagcaagtcctagaacctgtgcttatgacagcactctgataattcccggttattgcatcactccctgatggaaacccagcttttatttcagcaaaagtaatggattgttccagacccctgacctcccttgaagatgtctttttgttggatctggccctgtatattttccagttggttcaagacctagagaaatttctacagactctctcataccaggtaggtttttgtttgtttgtttgtttgttttgcttttgggataggacctagtcatattcagtccacattggaaagcataaattagtgtaacatacataagcttgttcattccactccatgtgttaggtttttgttagtgaacactgactgcaaaaataccaaggtatagccttatgcaagccaacatagtcacgttggacattagtgatctgagggtggaagtgaaatgaagtacggttttttttttccaagtcaactaaacgaacaggctgtatgttttacaatatgaattgggttgtgatatacaaagtgtttatccaaagttaccctcctctttgttttttagaatgacaagacccaaatgggagaattaggccagaagcaacaatgccctcaggcttagtgaaattgaccaaagtttgaaggtaagtgttttcagaccctggtttcctaggaccaagtcttggcctcatcaaacataatcacagtctccttttaccactttggcccaaacactatgaagccttttgcccactggctcagcttctcttgccatatactgattattaatgccagtaaaatacctaggcaccttggcagtaacttacgcaaatatgtatatttctaattacagggaaattgttagaacatgacttggattagagatacacagctaataattcaagaagaaataatgctttgttttcagtagaggaaaataaaagcttcatttgaataatttttcctcctttctctccctttttgttttgatacttacgcatgggcaataccgtaaactggcaataaaagaagttatcgcaaacagtgtggccatttctcctcagacactggacatcctacatctgttatatggtttaccatccatccacttccttgctatagctccaggtccacaattctttgtcatgtcattgctcttgacctataccatgactgataaccatgtacatttttaagaaaaaaatgtaaattaattaaaataatttaaaaacacatatccatatggtgtttgtgcatatattttgctttttctaatcttatctttgtagttcaaaaaggttaaacctgaatgtgatatgtgtgtgtatggaaactgaatgcactataggttcaaataggcaaggaagttgcttagtaacatcctgttcttgactgtgctatcataatttgcattttccaataaagtgtgtttccagccttaggacagtgctactattattgctggtggattttgtaatgtaagcttgactcattcagtgtcaagatcacctaaggccaaattcccattccacacgaattctctttcaagggatgtcctacccttcaagatgcccttaagaattctggattccttaaatatagaactatttatgcttactcataaaacagggaatgttataatatttctctgcttcactgtgtccaaggaagtagagaaatctggtaccatatttatgagcagcaataaaccatgtgttttgctttttcctaaaacaagcctggcaaactgtttaagaacacatgtgcagagcttgggcacagggtgagagtttggtggcacggagtgaggctagaggtgggcgtgtggagagtctgatatcctgatatcaaagcaattccattcagacttaggcctgagctgctcccagtcatccaagtcatttttactaatatctgacaacttgcaaatattgtgttacgttcaacactgaaaatgaggactgtgcatttccttttgtctaaatgatgattaaatggtgaagcagctacagaagtattgactaacgacagcatccatttactagaaaatatgtcatttgctactgcaaacatttatggtctgattatacctcatgttacactgcaatggtttgggttttttttttttttttgtatttttggtacatcagaaacacttttcccaatgtttgttagtttaagcattgttcaacatttatttattaagcattgactttataaaataggtaccaggaatatgaaaatgagtaagatatgttccctgacatccagtagctcatagtctagagatgtcaccataataataactagcatttattggacaccacctgtgtctcctgaagcctgttacctcatttaattttgacaaaaccttatgaagtgaatattatcacacaaacacacacatttagagaatgaatgtgaggctcagagaagttaaacacattgcccatgatcacagaaccagttagtggcagagttgggatttaagcccagatctttctgattctagagcgtatgttctatctatgaagctcttaccgattttattttatatcaagtgaactgtgtaatacataaagtcactcaggaaacagtactggatggggattatgatactaggcagtgcttactctagcaaataggtatcagagccctggcataggtcctcacttttgctaggattctgtcctactccacccttgctgataaacgggaagccacacgtcctggtccagcacttattctcaggcctcccagggacactcactctccatcacgtagtctcttccctaagtagtctgtgtttccctctgccttgcgggtaacttcatctgtgtgtaccaaacctgtcacccctcttagtagtcctcaaaagacaagacttcaagggagagttaatattctcagagttcatcagaaatacctgtttccaaggtcaagacccaccttagaaaggaggtcttcatataccctgtctgtgcttattttgtgttttcacaacacaaaatattttaacgatgatttaatttagttgtgtattgatagtctctgtcaatctctcagggttttttttttctgagggaaaaaattacattttgtaattttttaatttagaaacaacagcaataacaacttgagtcggtgacttctgaaccatttttgttctgattatcactgtaaacctaaatgtgtgaacactatcagtagggataatatttaccctatgggactgttaagcaatttaagatgagataagaaatgtcacagggaaaaggtgttactccacacatggtagtcgttattatttattgggttgaagtgttggcctcccaaagggcaatggtgatttaatagaatataagcaactaaatcccaggttaaagcagtgaattcctaattgtagaattttcctgttaaactatcaggtgggaaaggcctgtcaagatgtatatggaaggagtgagatccttgaaataattaatacacctggtataactcccatcattaggtaaacctgggctcatccctactagacagtaatagaaaattagaggataaaaggatagtcacaaaaataaatagaatatattgaaagctaactatgtactaaacagtgttctaggcatattttacatttattaattcatttaaacctctcaactccctataaagtagacattactaattatctcccttttacaaaaaaagaaatctgaacctaagagagtttaaaaaatttgcccaagaccacataatcagaaggaagattttgaatctgatttttcctcacagcaaagtccatgcattttccactttatcacaccggtttttgtttttgtttttgtattattatttttgagacagagtctcattctgtcacccaggctggagttcagtggctctcagctcactgcaacctccgcctcccaggttcaagcgattcttgtttctcaggctccagagtagctgggactacaggtgtgcacttgtattttttagtagagacagggtttccaccatgttgcccaggctggtctcgaactccttttactcaagcaatcctcctgcctcccaaagggctgggattacaggtgtgagccaccgcacccagccaatcacactgtatttaatatcacaacgaagtgcagtctgcccttctcaggatgatcttagatctatttttcagcaagtcgcattcgggtggagcaaaagcttttaaatggtggtcaattacacaatgattaaatttagtttaccattataggtcaaagggaagtgggaagagtttgatgactgtgtatttgtcatgtttctagttatagtgtacaactctgcctgtttatctgagtgagtgccaagaggtgaggtcagggcaggggctcttgcacatggcacatactatctgccccacagctattttgacttggacagtcattgtgctgggtggtaaaaattccagtgggctgggtaggacatactggggccctgtttcctctcatctgtgtttgagaactaggcagcattgcatcaaatggaaggaacaagtgatgagacatcaggaaaatatcagaatgaaagagaaatgcaaggctctaaaggaagttccaactcacttcgacaccctccagttagcaaagaggtgacagaatcccaaaagggcaggggagagattatggatagcaggctcctggaggaaaaactaggtatgtccagtagcagatctgtggaaactattagaaaccgagctaattgtggacttcttagcatgcctcaggaaatgggaaggaacttttcccttttgggcttgtattttttccaattttccttgttcgggaaataattaattctttaagcaatgtaacctcctgctgtgatttctcaattccacaaaagagaataattatagattaataatggaccaaaatagaaaaagctaaatgtgtgtagcagataagtaggaaatgttctgtcttgtaaagggtattgtttcggtgcccggcaacacagaaacaattctcatctatgcagctctaaatggatgttagaattcacccctctttcctactggtataaaattttcagtctcagtaggactaacgctttgacacatcctaaacctcaccaggagtaggaaatatttctcatagcataaatattttttcttccttgaactgaaaggtttgtggccttccccatgcatgataactgggcagttttcagaatatacctcacagtaaaacttagacttcacacctgtaatcccagtactttgggaggccttggtgggcggatcctgaggtcaggagatcaagactatcctggccaacatggtgaaaccccatctctactaaaaatacaaaaattagctgggcgtggtggcacgtgcctgtaatcccagctacttgggaggctaaggcaggagaatcacttgaaccagggagtcagagtttgcagtgagccaagatcacaccactgcaccccagcctggcgacagaatgagactccatctcaaaataaaataaaataaaataaaataaaataaaaaacttagacttcaagttttaactattgaaaaacttccatgaattgggtacagtactgagctaaacgttgtatatatgttatttattcaggaaatattttcaggtactatgctgagtgctaaaagcattgttctgccttttaatactaacaatgcctgtgaaaaatatgtaggattatccagactttataaatttaaaacattaggattcagaaaagtaatatgcacatgctcctatactttacatgtgacagactggaatcaaatggtttaggatgccccgaataactgaactcttaatgccccagaagcccagatcgggacccaccactgggagttacagccctctggagccagcttcagaggtgcacaggtttattctcttccctattcaccagtgaaagaagcccagagcctccattccaggcactctgtgcttcccaaagtaacaattacttaatttgacaagataatttaaagagattgccaaaataacttacaggagattgccagtataatcagccctcccatatctggggattctacatttccagattcaaccagttgaagagagaaaatatttgaaaaaaaaaatttaaaataatacaaataaaaacaatacaacatagtatttatatcatattgggtattgtaagtaatgtagagaccatgtaaagtatatggaaggatgtgcataggttatatgcaaatatgctattttatgtcagggagttgagcatctgcagattttgatatggaggcaggggtcctggaaccaacatcccatggatacctgagggacaaatgtaatcaccatgttttcccaggtggatttttaacagtggccttctggagacactatgcctatggtttagtctaattgttaaaaattgggataggtgaagaaagatggcagataggcacaatgggaggcagatatttccataaatgccttttaaatcagatcctttctagattcacttttggctctggatctggaagctatcatcatggcaaccccagagtcccattggtttgcctattggttaggtgggccaaggtgtccacatatcacaaaagagttctcaaaaaatttcttcccaataacgagggagatttatatttaagagcacctttagccaaactgaaggaagggaaagttcacaaatatggtaatagctcaagtcaatgaattagaggctttgtgtagggtaattgttgagacctccccagttgactgaccaaaacaattctttgttggctagcagagttagagaatagaattttgcataatccaagtatttcatataggtcccttctgctgttactggagcactagtgagctattgtatttgtggtcataatattagctgcataggtagttctataaatgtgtctggttaataatccacaaacgtcagtgttttacatttgtaagtaaagaagtctctgtccacagcaaaaacgttaccaggcaatattttttagcattaaaaatataaaataaaatcaagttacttcaaagttctaaagaactagaagtcaataaaattcataaatatttatttttcaataattctggatgtatcttaggatcctaatataggatgtacatcctaatatagttatgtttacctgtcatttattttaattgatatatgccagtacttctatagtaagattttattggtaaaatgttttttattcttcaaaatgcagattcctttcatagggtatattcatctaccattttccattctttgaaatctgaaataagtcctaaccttatacattcaccaggagtgtgtattaatcacttctcacactgctgataaagacatacctgagactgggtaatttataaagaaaaagaggtttaatgaactcacagttccacatggctgggaagacctcacaagcatggtggaaagtgacaggcacatcttacatggcagcaggcaagagagaatgagagcaaagcaaaagggaaaacaccttataaagccatcagatctagtgagacttattcactaccacgagtattgtgtgagggaaaccacccccatgattcaactgtcttccaccaggtccctcctacaacacatgggaattatgggagctacaattcaagatgagattcagatgggaacacagccaaaccatatcagagtgtatactttcattttattcctcaatcttcattccttaagttttcaacaaataatttgcttttgaaaggattaggagcttaagttggctttatagttatccagtaaccttttgatttctccaaccaatgatttgtaaaggaatcttcagattcagatttatcctttcctacttcatcttcaattgctaaattaagcatgagtcccatcactgagataacagtctttcttggacagagttatgccaggtctttttctatgtaaagcagtcatctattaggctgtcgttggtctgtcaagatgaaactgtgtgcattggatccatgtgaatgaacatagaacattatacaaatattgtatgtttctattctttgcttgaagcttctggttacttagatcttatagtgcttcatagtataaaaaatggttaaaatacttaaaagttttaaagataaagatgtcagtgtcacagtgcataactgggttttacatggtcaagtatacacacatacacacacacacacacacacacaatttaaaaaatctctgatgcactatgccatactcagcaccaatccccattacaactctcccaatgtttcctggccaggcaggtcaccaagatgtttgggactgtttatgcctttgcacctactcatcataatattgtgtggggatcaatgggagagatatttggcccatttttaagccatatcaggggatcttccacttcctaaactcacttagacttggaatttaagtctagactattttgtttttaaccttgctaacacctacctacctacctacctattcattgtccatagcctaggtagtcttgaaaaaccctccattcccgcagcttcccccaatgcctcctctgaactcagtgtcactcctgtgtgcctcctttagtgttttttttgtttgtttgtttttgtttgtttgtttgtttttgtcattgcactcaccaccttatattgtaaaagtctattactaaggaagtattcctccctcctttatgtgcagaattccttgacagaaaggataggtcatgtttacctctgtcttgcctccaatgcgcagcatgaagcctggctctatgatcagctctaaagaaatgcttgttgatgggcaaataaactcgagaatctcacaccagagccagaccggaagtttccttcatttcatgactggttttcacaaaaacaagcattagggagagtggaaggaagagcttgcaaaataccttactactgcattatgaatgtggagttgtaattttgaggttcttatccatgaagatggtccttaaaattcagaattttaattaccaacataacaccatcctttcttactagtatcattattttatactatgttttcagtaggacatatctgatggaaatacatttcttttgatattatttattataactggtgagctacattccacccaatagtaaatgcctctcagcaaaaagatagatacttttgatagttaatatattcagatattatgttgtttgtggaaaccataacttaataaattttaaaacagtgtcttctttaaaagtaattttttattaaactttgtattttgaggtaattgtagattcacatgcagctataagaaataatgcaaacaatactttttacccagtttcctccaatggtgacatcttgaaaactatcgcacaatagcacaactttgatattgacactgatacaatcaagatacagaacattttcatccaggcatcccctgtgcttagcccttttgtagctacgtctacttcctttgcccaccctcaccttaaaaccctggcaataattaacattttgtcatttcaagcatgttatataaatggaaccatagagtatataactttcaggtattggttttttccaatcagcataattctttggagattctttacttagcatacttctctggagatttatctaggtgcttgtgtactagtagttcattctttgttatcgctgcatagtatttcatgctagggatgttgagccatttacccattgaaagatacttgggttgtttctagtttggggagattataaataaagctgctataaatactcatacacagatttttgtgtaaacatacattttcatttctctgagataaatgcctaggaatgagtgtgatttctagatctgatagtaattgcatgtttagtgtttttaagaaaccaacaaaatattttccaaaattagatgtgccattttatattcctaccagcaatgtgacagcaattgtttttctgtatcttcaccagcatttggtggtgttactttttttattttagccattatgatcagtgcatagtgatagctcattttggttttactttgcatttctttagtggctaatgatgttgaacatcttttcataggcttatttgcatctgtatatcttctttagtgaaatgcttctctgttcctgttgcctattttctaattagattgttttttgactgttgagttttaagagttctgtatatattcttgatagcagtcctttgtcggatatgtgatttacaaatattttctcccagtccatagcttgtcttttttattctctttactgtttttttccacaaggcaagagcttttaattttgataaaaataactttttatacttaattggcaaccaaatacctaaatgtcttttgatagaaaaacttgtcctagataatgtaaaatcattttacatattcacagatccatctccactaatgtcatataagtttaaaaatcacaaagtaatttgaacagattcctaaattataaattagttaacagttattttttgctctaatctttagttgtacatttacttcaaataaacatttgttaaaaacgtactctgtactgaggaatgaggatacaaaactcataatttgtcatttctttgcttcagggacttacattttactggattacatctaaatttttatttggcagttttattccaggaagatcatgacagtcttgttttctaaatcttaactgccttttgatgaaaaagaaagataaggctttaatttctctagtgaaacctgaagaagtaaaataaaataacttgtatgtcccttcacaagccacagtcagaacactgtcacaatctcgacctttgctccccaaaccctattttgcaaaccagatgctatttctttggacattacaggctattttcaaaatacatcagaacttaacaaaacatcatattagctaaatagcactataagaaactgcttataatattaaaattatgtcttgagtttataattatataaaaattgaatctaccctagagcaaaaattataattaactactaaaaaatcgaataagtgatttttttttttttttttgaggcagggtctcactctatggcccaggctggagtacagtggtgtgatcatggcttactgcagccttgatcttctgggctcaagcaatcctcatcctcccacctcaacccctccagtagctgagaccacaggtgcaccccaccacacctggtatattagtttattttcacattgctgtaaagaactacctgagcatgtgtaatttattaggaaagcaggttaaattgattcagagttcctcctggctggggaggcctcaggaaacttacaatcatggcggaagacaaacaggatgcaaaacacctcttacaaggtggcaggagagagagagagtgagaggggaactgtcacacacttttaaaccatcagatctcgagataactcactgtcatgataatagcaagggggaagtctgcccccatcattcaatcatctcccaccaggcacctcccctgacatgtggggactacaattctagatgaggtttggttgtggacacagagtcaaaccatagcacccggctaattttcttttcttttctttttggtagatatggagtgtcactatgttttgtttccctagctggtcttgaactcctgggctcaagtgatctgcccacctcggcctcccaaaatgctgggattacaggtgtgagccagtacacccagccaagaagtgatttgtataatggcaggattatgaatgattatttctgtgtctttaatttgatcatatttttaaaacagtcattatttttggtcatcatgctatatactacagagagcagtttttaatttgtgaacgtgtaagtcaacttgatttagctgaacatagcagagtcatcaatcaaactgattgatgactaagggtccgcagggtaacacatcatcatagttgtttccatggtgatgaattatgatgtcacaaactcatcaagactgtgactcagtgaaccatctagacagaggatgaaatgcagtagttcaccaacatgtatgccatctttgtattatatggtattattaattaaaacgaagggctgagtatttctttcattgagattacatgaagatattacgtatattcagacttgcctgaacacggctatgctggttttaaattgaaggttttcacaaagcaaaaaattgagaaacagaatttgacatagaattgtgtatttattagaaaagatcttttcttctcatattctgaaaagcacactcattaattacagttaaattcaggcaaatttggcaaattttcgtcagtatacttattcttttgttagttaatagctttgcttttcagttttagatattggtattaaatatataaagagaaaagaccttagtgttctcatgctcagagattaagagaatagttataggtttgaaattaggcactttccctgatagtttttgttggtacatgttttaggttatgtttctatgaacaaccagatgcaaacgtcctggcattcatcctgcctgcttgctgtttgtaccatctccgtggtagcaaccatccaagctgctggaagcacagactgagctctatgagtcaattattttatatacctgggaacgtgctagccttcctgtcactctttgatgtcactatgtagacagtttgcagcctaggcaacatggtaagaccctgtctccaaaacttccaaaaattagccaccaggtgtggtggtgcatgcctgtagtcctagctactctgaaggttgaggcaaaaggaaccctcaaccccaggagtttgaggctgcagtgagctatgatcgcaccactgcactccagtctgggagacatagtgagatgctgtctttaaaataataataataattttaaaaattaaaaaatatctagacaatttctctgctttcaagactcttcaaagatctcaaagagaagctttactctggagtctcaacagaggccattcaaaaactcaacctggtttttcaacaataaattagaaatgtaatgctaacagtaggtgccaaggccgaacatcagggaaaagacattagtgaccttgagttctagactagattttaccagtttctgaccttcaactctggtactcgattttctcataaatgtgagaaaatatcttaaccgtatcacagaattgatgtgagaattcaaaataaagcatatttaaagctcctaggttagtgcttcatttatgaaggtcagtgcttcataaatgatagttatttttttccattcaaaatagagataaaaaagactttatctcactaatgtgtcatgcaaataaggattaatcctgttttctattcctgaagcatacagaatgtgatttctttctccatcatttccatctgactatcatctgggagaacacacagctgctccacatctggtgcaacacaggcagatgtagctgtccagagggagaagagtgtttgcttttctccacctaaacactgaccctcttctgcttagattcaaagactgtcttccttctgcaggtttacctgagcctggactcaaagaattaccttcattatgagctaaaggaagtcaggcccattcttcttctgcctggcccctctggctctttggcacttcccacatcctcctcatttggaaaggcttcatgactttctggttcacaaagcagctctgttgttgcttatttccactacagggaaaaagtgaaacacttcactcagggcgcagaacaatggaagtccctggaaggaaaggcttgcaagagaaaaccaagtggcttctgagatattcgaaagtccagttgttttccctttttaaaaattttcagatgctctttgatgccatttcataaagcctgtgattgggccaaaagtcttagttcaccatgtaccacaaatagtgtactctatatagcatatgcttaactaagaaaaaataaagatttagaaatagatgtattgaggacatgccattaaaagcagcttccattgaatcaactgtttttcagagtactgtcaagattaccttaaactagtctaatcaaggtaggtggtggattccaaacttgggaaaaagtgagtctttgtattctgtgaagtttaataactacccaaggaagaagtgttggatacaacaactatgagtatcttagaaagtatgtcttttttttttttctgagtcagggtcttgctctatcacccaggctggagtgcagtgatgtgattataactcattgcattgcaatcttgaccccctgggctcaagccatccttccatcttagcctcccaagtagctaggactacaagtggatgccaccatgcccagctaatttttttcttaatttcatttttgtagagataggatttcccaggctggtatcaaactctcaaacttcctggtctcaagcagttctcccaccttggcttcccaaagtgctggcattataggcatgagccaccacacccagcctgggtgtctgtctttatgctaaatgtccgagcctttccatttgtcttttgcctcttcataaacctctgctgagctttatcaggtcattcacatctttcattacaggcaagtggtaaacttagtaatatgcttcctctggtgacaatgggcaaaggactagaagcataagtaaagaaatagtagactgaaataagcggattttgacatgcaaaaagatgcagcaaggtgaacctggttaagaaatagactcagagagcttgaacatggaaggatgctaggacaagtggcagctaaggcagaaagacagccatggttccagatgtctggggaaacaatggaaggcagatattacaaagttttccattttgtaccagaagtgtccgtatgaacacaaactcctagtaagtgttcttaattgttctgtgggctgatgtgcatttttctcctacaataggaactagcaatctacatattatttaccaagccttcctagatagaagcatttatgattattttttgtttatataaatgtcttgcatttactagaaaatcatgcttttcgagaacgcatttctattatggagtttcttaaagagagaaaaaaaatgtatggctttagaaaaatcctagtgattttttgacagtatgaactgtattgtgtgttcttgtcttggatcaatatcatggcacaatgctttgatagtgtctgaagattaagatatacaatacaatttcctcccttcccttctttcctttttccttccttcctttttcctttctttcttttccttccttccttcctttctttttctttctctctctctttctcttccctccctccctccctctctctttcctctttctttctgtctgtctgtctgtctgtctttttcttgagatagggtctcactttgtcacccaggcagaagggcagtggccctatcatatttcactgccacctcaaattcctgggctcaagggatcctcccgcctcagcctctcaagcagctgggactacaggtgtgcccctccatgtgcggttaattgtagttttttgtttggggtggttttgtttgtttgtttgtttttgtagagactttgttgcctaggctggtctcaaactcctgggctcaagcagtcctcccactgcaacctcccaaaatgctgggattataggtgtgagccaccatgtccagcccaataccattttcttatgtttcccatatatgcataattttacttgcatgcaattctgaatggatgaaacatgttttaatcacctatttttctactttgtagaagagccaaggtaacatgaactaaatcattaaagcagttgacttgttagtggattgtgataggactcaggcatttcccaaagggggaacccatattttggtaatcccagacattttaattatatttttctatccattcctcaatgccacaatgaggaacagcattctttcctgggaagtctcacaattttgtcaaaagtagaagagttgcctttgacgaatacaaatccagcaataaagaagaacaggtctaacaaatgaggccaccttggaaaatgtcattttgcccctttgagccttgcccatcttacctttagaggaagagatgggactgaatcagttcaaagagcctcgatagctttaaatgtctgtgattgatttttctgcagagcaagatcaaacaaaacagtatttcctagctgctgcccttacatgtagtggtgattcacagagaatttggggaggaaagtagccattatgggatgttttgcaaaaggcaataccaagattgatcatcacctgagggcgatacactatagttgttcctctgtatccatgacagattagtcccaggaccccttgcagataccaaaatccacagatgctcatgtcctgcttataaaatggcatagtatttgtacacagccttgtatatcctcctgaatactttaaatcatctctagattacttataatacctagagttgtataaatgctatagaaagtattgttatactgtatttttaaatgtacattagttttattttttttccgaatacctttttatccatggttggttgaatccacggatgcagaacccatggatatggagagctgactgtaatagtcaaagacaagagtggctggtggtaagcacactatctgtccacaagtgaatttcccctaagaatcctgctggtacatttcttcatttcttgagattattgaaccacgtgatttgcctcactgcttatttcaccttctgggtgacatgggctgtgaatgtgcagttcaaggcctaaatattagccctgattcaaaatggacattaaccaaaaaaacaaacaacaatgatactggccaactgacttctctcacttctctcttctcttttctttaattcattccttacctatttagaatagctgaggctcatttttatcttcttatgacagccagaattgtcatctattaagattaagtaaggaaggcataattgatattcacaaaccaccccaggatttatcagaagtgagggtgtttcatatggattactaattgtctaaaatttggctctaagcacctgaagatcactaggcaggagagaagagtagggtttgttgtacatgagaagaggctgtggggtggggatgttcaccgagaagactgctttggtctttgatactagcatttttccttctatatggttaacaaggcacatattttcatttttatatccccagaataaaggcttgaaaggaaacaaaatctcaaataaatggactaatttgttaaattctggactaaacctcagtttattttaacagctttaacaacggtctctggagctcataacacatatagagcactattggtgtcacacaaaaccttgaaatcagaattgccacagaccgaatctgatctgaaatggcatttcattcaactgcagctttgtgtcacaagaacctgtctctgttttcctaacatgggtatgatgcatattcagaagcagccgagtgatttacttcttttttcattacgcttgtggatttgcatagattcagaaggggcatcttctgggaggtataagagtttatagaaagactaatttcttgactaggcacgatggctcatgcttgtaatctcagcactttgggaggccaaggtgggaagatcacttgagaccaggagtttgagaccagcctggccaatatggtgaaaccctgtctctacaaaaaatacaaaaattagctgggcgtggtggtacatgcctgtaatcccagctactcaggaagctaaggcacaataattgcttgaaccagagaagtggagattgcagtgagccaagattgtgcccctgcactccaacctgggcaacagagtgagactctgtctcaaaaacaaaaaaaaaaggaagattgatttcctgtagacagaaggagtgtttatattggcagcagcaatgcagatcaaaactttggggtcaccctcttgaatatcttatttgtatttcttcttgggttactaaagtcttgaggagaaaaatgaataaaaggcttaagaggattctcatttccatgcaaagcttctccacactcctgagagaagtttagggtcaggaaggaaggtcagacaatataaacctcagcactattcagtaaaatagccatggggaaaaatatggtaagtttgtcttaattcatacccaaggacatttagcgctcagaaaactaaaatactttttatttatttatttatttatttatttattttgagacagagtcttgcactattgtgcgggctggagtgcagtggcgcagtctcagctcactgcaacctccacttgaacctccaggttcaagtgattctccttgcctcagcctcccacgtagctgggattacaggcgcccaccaccacacccggctaattttttttttgtatttttagtagagacggggtttcactatgttggccaggctggtcttgaactcctgacctcgtgatccacctgcatcggcctcccaaagtgctgggattataggcataagccaccttgcttggccctaaaatacttttaataagattgtctcatccttctcttggttttccaatggaaatggtggtatagcaagtccatctgaaacacttctgcaaaataacaatgaagctaatcactgtgggaaacatttacatcatatgtatttgcatacagaggaaattgataatcttgagacatcagcatactagaatagcaagagacatgttttattctattatattctcttagtcagcaatgtttaattgttgcttaaaggaaactgaataaaacgtgggcgcagtggctcccacctctaatcccagcactttgggaagttgaggagagaggatcgcttcagcccaagagtttgagaccagcataggcaacatagtgagaccccatctctacaaaaaatattttttaaaattagtcgagcatggcggtggctccctgtagttccagctacatggagggctgaggtgggaggatcacttgaaccagggaggtcaaggctgcaccctggcctgggcaacaaagccaaaccctgtgtcaaaaaaaaaaaaaaaatacgtaaagcaacagtttttctataacggattgcatggtaaaaggaaggatgactttcttactataactccttatgataattttttccaaagtgttaatcttaggggttgaaatttttataggtaatcattaactttagtagaacattattttaaagtttaggtatttcatctgagtatattactctggctttcctaagctagcttagttatatatgttcacttcagtttgagtctccactaaattttaacatgaacaaaatattatatgcaacaccatagaagcaattgttaaatcattgttacttttaatatcacctaaatctaacctaagtaaatgtgtttatttttattaccaactgatgtagatatacccacatggacagaaaacagcataaaccaccaaaaggacttgaaaattccctcttcaagacttcttttgccaatgactaatgtttaatgctatttgctagagattctggtgccaggaggatttctaaccaggttattttatcaataggaataaaatatcgagggcttaaattagtgtaatctctcaagatcttgaatttgacgttttcataatttttacttaatcatagctcctggggattggaattactcttttagctggcccgagtctgggaggaggatccaaagtctttgagttgttttcttttatttctttttagcccctaaagcactggaaatggttggccctgaagtgctcctaaggtaaccgcaagatgaggcaaaacaggattgagatgaaaaccaagctcacccacatcctacgtcaattagctatttttttttctgtgtaaacaatgggagggaggtggattgtagcttttatggtagaggttcctcggcacctcctgacgcccccaggggtcccccctgccactgccctcagcccaaatataagctgacaacaaaatgtttcttcaaagtgctcattgtttactctattctggcttcttcttaaaggtcatcatcatgttgaattatcttgagaaaatcctctgaagtgtatgtgtgtgtgtgtgtttaggaaggatgtgaggaggattgggaggtgagtctctgaataacaagttgaaaaaagagtatggaggaaagcggtgtttaaaattgtccaaagccatcggccgggcatgatggctcacgcctctaatcccaacgatttgagaggctgaggtgggaaaattgcttgagcccaggagtttgagaccagtctgggcaacatggtgaaaccccatctctacaaaaaaagtacaacaattagctgggcatggtggtgcatgcctgcagtcccagatactcaggaggctgagatgggaggatcacttgagcctaggagtttagggctgcaatgagatgtgagtgcaccaccatactctagcctgggcaacagagcaagaccttgtctcaaataataataataatatataaataaacaaataaataaaattatcctaagtgaaatcagttgttgatagaactgaagtacatcaagcctagtgggactgtggttgtctctccagcctaaaaaaaaaaaagaacaaaaacaacaacaaaaaaacttaactccaaaattgctgttgctccatttatttcaggtgtaagacttctttgagatttaaaaacaatataatcatttacaatgtactttgttggacctaagcataggaaaattcattcattcattcattcattgagtacctgttatatgccaggcaatgcactaggcaccatcaaagatgaataagctatgtgctaaaattcacagtctaacagaagaaacatgaaagcagagtggaaatatactgtggcaatacatatttggatatactggtattaaaaagtaaggatgtttcagctaaatcttttttggtgtttattttttaaaaattcatctattaacttcctacacaccatgcatatattcagctaaatcttaaagtatgagaagaaacatgccattcatgaaagggaagagggagccagtgcatcagatacaacctatgcaatcgtgaagatttatggcagagcacaggatatttggggattggcaggcatttcaaaatggctggcacataaagttccgggatgggaacaggctggcaagagaagagatcatcggagccaaagtaactgaactgtgattgaattttagatatgataatatctataggaaacctggcaacccggtgggcaggtaaatatgatagagcgaagatagaatcttcaggccttcaggggactaagcaggaatagaataattttattgagcactttaagtggacattatgctagattattttacatatttcatctcctttaatttacaccacaaccctgtgagtgcaggttgataaagaattaaataaaatccaggtgaagtagcagcacctatagttccagctacttgggaggctgaggtgagaccattacttgaggccaagagttccaggctgtagttcacaatggttgtgtctgtgaatagccactgcactcctgcctgggtgacacagtgagacctcatttctaaaaaagaaaaaaaaaattgagacagggtctcgctctgccacccaggctggagtacagtcacgcaattacagcttactgcagccttaacccccaggctcaaacaatcctcccacctcagcctcccaaatagcttggactacaggtacatgtcaccacacctggctattttttgtattttttgtagagatggagtttcaccatgttgcccaggctggtcttgaactcctaggctcaaatgatcctcctgcttccaccttccaaagcgctgagattatagacgtgaaccactgcacctggtctagaaattatttaataataaaaaaatgaagacagaattcaatgaagagcatagaagagtctcttaaacctttgttttaagctatgagccaggaaagagatggtggcaagggtgagatggttgcagtgcttttttgttcacttatctcaggcctgtgtgttctgagttaaagacaagtcagttggcaagagaaggagagaggaagcttcccagaaccatttgaaggaaaatttggaaagtcttctctaagggagttgccctcaactaccttttaacacaaatggaggactgaaaaacaaaacaaaacaaaacaaacaggaaggaattgcagatatacagatctttggcctttcaaactatggtatctcttagtactattttatatattgataataattataatttttctcaaacttcccaaaagtggaacattgtgggaaataatatgggagtggacatttgaatttctgtttgactttgcagcagaaatctcttttctaactctctctttcaatctcaccatcagagccatctgattgcttgataacatgattctttttgcccagcccttgttatcctccctcctgccctagtcaccatgacataggctccactcatttctacctaggaacctggatgcactgctttgcactattgcctcctggcaaaacagggcaatgagaaaggaaatggaagcccaaattcagagccctccttcccagcacaagaatgaggagatgccctttttccccggggagggggattcttccctctctcttcagtaattgtctttatcactgtcatgttctagccagtctttattatccccgccacacaaatttcatgttcttctggcagtcaaatcaggaaattcaaggacacaactgctctggcttcgtaaagatggggatcaaattgtttgagttgctgatagcaactctttgcttcttgattctccatgcctcctcaagcttttttggctgaacttttagccttggaacagggtcactggaaaatacttcttaatatccttaatttctaattctaatatttgccttgtttcattttgtttatttggggaggatgaagttcaggtgttcacctatcaaactcacttccttcttttttttagacaaggtcttgctctgtcgcccaggctagagtgcagtggtatgatgttggctcactgcagcctccacctcccaggttcaagtgattctcccacctcagcctcccaagtagcagggatcacaggctcgtgctaccacgccccactacttttttgtattttttggtagagacggagtttcatcatgttggccaggctgatcttgaactcctgacctcaagtgatctgcctgcctcgacctcccaaagtgctgggattgcaggtgtgagccaccgtgcccagccctaacttccttctgatcaagtcattctcaaaaataaacatttaattgactgtcaactacaatgataataagacaatgtttgccttaaatgagctctaaatctagttgaagggataacacatggaatggactggtaataaaaagtgggctttgcttggtgctacagttgtgatgtgaactaaagagggagtgttttggactgactttgagttggggaggctttatggaggaggtgacatttgagttgggccttacgttgtattttatgaaataaaaaaagaggaaagacagtccaagatgagaagacagtataaataaagggacagaggcatggaagggaatttcttggccaaaggatagtaaaaagtacagaaccactaaagtctagagcacataggctagaggctagaataagtgagaaatagctaatcctaggaagataaattggggcttaattgtaaaaacctttgcatgctatactaagaagctttgagttcattctcttggcaactatgagccattacatgtttcaaaagatagatctgatggaaaaacagaagtatagagggtaatattctaatgtgtaaacttctactgtgagtccaaaagaatatggtatctatctctgaaccatgttcaatattttgcttagactgttcgaactatgtaagaataagaaatactaaagtgttttttctctgatataatatttaaataccttttagctatcaattccttctaatttccctttaataagacatttactacaaatagacatcattcccatagcaatcttttcttgagacaaagaggtcagtaggccaggttctgcatagaatataagctatttttccattttagaatgccactctccattgatgtctactctcgttaagtagaaaattccaagaagtactaacaaaattatgttaatttgtgtatgtactgacttccagacatttggaaccagattctgaacctgtaactcatttaaatcttgccgtgactttggtttcccaagttctaggtctttctctgaaaatttaaaatgcttctggaaagatattttccatgacacttttgccttaggaaaaaaatttttggtcaacattggaagaaaaaaaaactgagacaacatatatcttgctccttaacatattctgtatgaaattaaggtcttattgacaatctacgtatcagagcctcgtacacaggagctattgaaatgatgtgtcagttcagaaaatcatgttcattatttctgattctcatcataaacaagcagtaaatcaccgtataaggggtgtatgcattagggcctcccacataaacttcacctctgcgtgtgtaaacattttcttattatcgcaaataatcaacaggagaagagcaaatgcaagtttagcttttctccagaatgtttatcatggttactttaaactgtttataggaaagagtgaactataaatgtctttcaggaggtgggtaggaccatatggctcagaggcttttctgcagtaaaatgtttggttaaattttaggcaacagacagtccttccacagcaattatttgtgatttcgagcatcgttgttgatactcaactcctgaaacaaataacaccgacctaaaacatttataataactgaagaaaccaggttccttttaaccctgctaggatccagctgcccccttgcaacccatccccagtcagctgcagctcaggcaagcccagcctttccatccctgcacatcagactgtggtgcagagaaactccctgtgttcttcaaaacaaacattggatgtaatccacctcaatcttttccatggtgaggctttacaaattttagttttctctaagaagatagcctgtatattcaattgcctgggtaaaagtttaatttctgatgcgtaaagcatatcctgccttgaaaaatatctcaggaaaaataaaggccacaacagtttcatgtgtgcctatatcaggattgctgctgagtaagttgtgaaatgtttttggatttctgagccatttggatttcagaattgtggaggaattctggatctgtattttattgtgtattaccaattattttcctttctcttttatgtgacgggtagtattttgattatttaaaatcatctttgtagaaaaattattggcagctatgaatttcatttcaagatatttaagatgccttagaaacttttctaaaaacagtataataggattgagaaccactcatgtatggcctttactgtttcgaggtttttcttttttgacatgtattatttgatgaaaccctatgagattaggtctttacttccgaaagaagaaaaccaaattcaagggcaattaaaaacttgtcaaatgtctcaattttagtaagaaaaaaaaccgacattggcctagatcttaatctgtgcccagtcctcttcccatccctcttttttttttttttttttttttttttggtggctgctctcaaatttttgggctcaaatgaacctcctaccttggcctcccaacgtgctgagattacaggcatgagccaccgtgcctggccagctaaggttaatttagtattgaagaaatatttttgttatgaatttagtgtagccaagtgtgcagtgtttagaccatctacagtaatgcacattaatggcctaggccttcacattcactcaccactcactcactgactcacccagagcaatgtctagtcctgcaagctccattcatgggaaaggcctcacacatgtataacatttttttgtcttttattctgtatttttctatgtttagataagtttagatgtataaatacttatccttgtattacggttctctagtgctcagtacagtgacttgctgtacaggtttgtagcctaggaacgataggttataccatatagccaaggtgtgtagtaagctgtaccatcttggttcgtgtaaggacattcagtgatgaaattgcctactgacacatttctcagaaggtacccccatcgttaagcaaccattactgtattagaaagcagaaaaacaaattcagctccggacttagcctacccatatagcatcattggccagaagaaaatcactttgctttatgaatcccagttttctgcgggaatgaaatgaggtaccatacgtgatcctaccagcataacacctgccaaatagtgcacattcaatactaaaccatcctttttatgcctataaataaaggatttgtactatatcaagagcttctctatgtctgaagttacaatagagtaattccaaattatctttcatggaatcaaatccctgatgatcccttgattttctgagttctgtgaatttcatcacagcccaatttgacccattactgctaattcagtgtttttattagtaaattatatttccaagttgaatcaaaacaacagtatagcaggcacagcttaagacacaagataaataagttgttgcattcaccagtcaaaatatttttaaaaaatcaagaagcaatcactgaatagttttccttgatttagataccaattaggtttaatgaccaaatgagactgataatcagagctgaggaactcaatcaacaggattgcaacatgctttttttaaacctcttgaaagatcacatcactacagaataaggaaacctatttatttatttaatttgagacagtctctctctgtcacccaagctggagtgcagtggaatgatctcagctcactgcggcctccaccccagttcaagcaatttcatgctcagcctctgagtagctgggactacaggggcacaccaccacgcccagctaatttttttgtatttttagcagagacaggttttcaccatggtggccacgatggtctggaactcttgacttcaagtgatctacccacttggtctcctgagggaaatctatttatgactaatgctgttctttttactaattgtttcattggctgtcagcccttagaggaaaaactgttcaaacaaccttttattcatagacccatgttatttaattttagaattatttcccatgtatgcacaaccgaattttcattttcataacaagaaaacaaattctttaagtgagaaacagtacattttacacccttccttttcacaaaaatctcacagtattttctgacttatggtcttgataattagcactcctgtttgctcgtgttctctttctttcacaagcaatgtgatcttatttttaaaaaggacctgagacaagtagacaattgacccttgaacaacacagatttgaaaagttttggtccacctatacacggattttctcccacctctgccacccatgagagagcaagaccaagccctcctccataccctactccatctgaagatgaccagggtaaagacctttatggggattcacttccacttaattattagtaaatatcttttctcttccttatgattttctcaataagtttcctttatctagcttactttactgtaagaatacggtatagactacatataacacacaaactatgcattatcaactatttatgctgctggtaaggcttctagtcaacagtaggttattaatagctaaattctgggggagtcaaaaggtatatgcagattttcacgggtggttggacccccccagcatccatgttgttcaagggtcaactgtatatcctaattgttatttgacactggaagaaattagatctcctggccgggcgtagactcacgtctatcatcccagcactttgggaggccgaggagggtggatcacctgagatcatgagttcgagaccagcctggccaacatggtgaaaccccaactctactaaaaatacaaaaattagctgggcgtggtggtgggtgcctgtagtcccagctactcaagaggttgaggcaggagaatcacttgaaccctggaggcagagattgcagtgagatgagattgtgccattgcactccagcctaagtgacggagtgagactttctcaaaaaaataaataaataaataaataaattatatctcctcttagaagtttgtccctctcttcaactgaaatctatcacagttcgacctacatggtagttgcattgatctgtccatcctggtgccacatatagaacatctactttgtcagatactgttccacatacagtaagcagaacacatgatcccagtccacatgaaggatggtgtccagtcatgtatggcctgattcttttctgtaaagtgctttcacatttgtagttggttcctttcctagagcactcctgtttttgcattcttgtagaaagcaaattatttccaccctgtcactgatttttttctccaattcaaacaatacgaactagaaaagagaactcccttgtaatataaaaggaaatagaaatccctatgtattcaatgtttttaaagtttaatatgattcctcttagcaataaccagcaaaaagaaaatgtttctactttaatcttttcttttgaactgaagtgttcctctatgtcatttacatgacaattggcccaaatctctctgttaccaggacttggtattcaaagtaagaggcttcattaaatttcaagaggacttttttggggaaagtttttgtttgttttgttgtgttttatcataacaaaacaaggcatagtgaccaggaagatggagtttctagttagtgcatacatatacatgcttatggttacttaatgtgatagaagcaaattattcagatgcctcttctccacagaaggttttggtcttcagcacgtaaagcaacttttttttttttgtttttttgagatagagtctcactctgtcaccaggctggagtgcaatggtgcgatctcggctccctgcaaactctgcatccggaattcaagcgattctcctgtctcagcctcctaaatagctgggactacaggcacgcaccaccacgtccagctaatttttgtatttttagtagagacggggtttcactatgttggccaggatggtctcgatctcttgacttcgtgatcctcccgcctcggcctcccaaagtgttgggattacaggcatgagccactgtgcccggcctcatgtagagcactttaaaagtacattggatccatagtaatcacttaactatgaacttgtatatccatatcaaaacttcatgttgtacagcttaaatatagacaataagaataaaataaataaatgaaaatattttaatatgctgagccatgttctggccatttttctctggccttatgtagctttagcttttcattctcaaagcatggatcaaagagctataagaagaaattaaccagagactttatcctgattgtttcacatttccaaaggcaataaatcagtcatgggctgagagaagagaactgaagtctaccacaacaaatatatttctgccattttttcttttatttcctataggttttgctttatgaattttgacatgatattttcatcatgtgtagatatcatacctctttatgcttttattgcaggtgaagtcatttcctaacatcactgctccctctcccttctcccagcagttatctatgtgaaacaaataaatgttatttgtgaggttcagctaattcagataattagcattaccaagaggcttacaattattctggaatttgtgtttgcttatttgtttccccaaatacagctaaaggagaggagaggatcaccagatcttatagtaggcaaaactatgaattattagtaaatcttcctcctggctttctatctcactggctgctcattctcattgtccttcactctttctcctctgtttaacttccaaatgccaagcatccctgggagtattctcttcatttattacattcactcaaatggttttaaataccatacatatactgatgacacctaacactctagttctcgtctgtgtctccctgaactccagactcgtaggtccaactgacttctgcatatggctgtccagtcggcatctccaattgaacatcgtcagaacaaaacttcaggcttttccccaaccagctcttctggtcttgcccatctcaataaacaccactgctatctacccaattaattgagccggctatctggtagttattcccttctttgcctcactgtcttctgatccccatatcctataaactctaataccaagtatccctggaatcctttcagtttttcctatctttacttcttctccttagtctaagctattatactctcttgcatagtttagcggtagtttttaagccctttttttatttttattttacgtttgccttttctaacaaattctccttaaaacagccagaatgatctctttgatgtatgatttagccaagtgtggtggctcccactagtaatcccagctactccaggaggctgaggtgggaggattgctgggagttcaagaccagtctgggcaacatagtgagaccccatttctaattaaaaaaaaaaaaaaagaagaaggaaacatgaattagattttgttgctcccttgtttaaactctctattggctttttacttcatttagaataaaatgaaactccctgtcctggcccctatttgatcttatttcctgtcactttcccattgtctgttatacctcacaatcactggactgcagttattgctgttcctccgaactacaggccttagggcctttgcaattgctattttctatggctggaacactttctcctcagatctgcaaaagattggtatcttgtttagtcagatctcaaattaaataccacactctcatagaggccttctctcacctcaggctggtgttggtagcagtcattgaacttcacaacaccttatgttaatgttgtgcagaacacttaccactgcctgatattttactgataggtcttttgtctgtttcctgccactcctgcccctgaaatagaaagcaagctccatcagagaagaactttatctgtttgttcacggcagtaattccaggccttggaagagggtttggcacacagatgttacttaataaacataagagtgaatgaatgaaaattgttagaagacaccatctaaagtgagtcagacaatatgtccagcttcttgtgtgtgctaattaatgacactttgtggactatatatctgtatataactacttcatttcttacagagccttgatagatgaaagtaactagacatttaacttaaaaggtgctaggtcatcttcagttccaggctgtaagcattaagattgactgtacacgacctgttaaaaccattttctgggaaaggctcttaagtacctgtcagagtttacaatttgagagcaaacataaataaacccaaacgcctttcaactttgaacatttgatgcttgaaaatcacctctatttaaatttttgctagtcacatcttctcatcttttggtttcaggacctgattcatcagtttctatagatccatttataaactcagtcagcattttactttgccagcctatgagcacaagtaggcaactggaggcttggaaaaaacccagacaacaacaatttgtttttcactggttctgctttcaaacaacttccaagagcacaatacagcaaaaagtgagagttatctatttctcccttcttcatccgaatacaaaatacatcctattttactgctttttttttgtcttttgcctctactttaagacttatctaagaaataaagaaaagccaaccactcgttctatccacagaagaaaaacacacaccagcatagacaacacaaaagactgtgtctagatgttaagactatatatcctataggactataattttcatagatctaaaaagtgagaaacatatatatgtataaaattatgtgggatgcaagttactgagattttgaatatggggctctgtcatttaccctaaaatgttcagtggtcttttctattttttctctattctcagtaaaatagaactttctcaacaattctggctcctactcttccaatgggctcagcttgtctcatgatttaatagtactaaaaaccttttcttaaaaagaaaaaaaatcctttttaaaaaagtttaggtataaataagaaatttctatattatgaaagactggtttgcaaagaaactttaatatcttctggatctcatctcaatcacagtctatgaaggaaataaaataagtgccttctaaaacggcctattatactactatagctgttgtctataaggaaaaagtttgttagtgagttgtattcaatagaaaacctcaaagatggctgggcgcggtggctcatgcctgtaatcccagcactttgggaggccgaggtgagtggatcacttgaagccaggagttcgagaccagctttgccaacatggagaaaccccatctctactaaaaatacaaaattagctgggtgtggtggcgggcgcctgtaatcccagctatttgggaggtgggagaattgcttgaacctaggaggcggaggttgaaatgactctagatcatgccgttgcactccagcctgggcgacaaaagcgagactctgtctccaaaaaaaagaaaagaaatcctcagagaagatatcctagaactatttagttttcccttaatcgagtctgaaaacctcctgtgcccttccaccacttaataatctaaccaactattgtaaaattacctattcttctaaaccaccaaatagttcgaatagaatagccttagatatctaataactaaatgaaaccacagtttacctctctaggcttcagtttcttcttcataaaataagaagcttgaactcgaaaagttttagatgcgaagttcccaaaaatctagtagaggaagcaaaactctgtttggcaccctgtttccttgccctggacttttagcatttctttcttctggtgtaaagtcaaacaaaaaatagagatgaatctctaaatttacctttttattggggagataagagttgcaatacagggcatacacacagacctgatagtcttctgtatgtcagaagaacaaagagaaggttggaggttttacgaaaaggagaaatgtcttgtcctgaaagaaatttcactggcactagtaaagttgtggggagtggcaacctctgattggtgagtgacaacagtgcagtaggtaaaactaatcttagactcacagtggttgtcttagctgctattagataaaagtgatttcaggttacagcaggcagtttcagcagctaggtttgcagagaattacattcctagaacatgatattttaatatacatatccattgtgaaataaatactataggcaagcaatttaacatatttatcactttccatagttaacatttttgtaagagcacataaaatctacttattctgcagattttgaatatacaatacaatattatttactataatctttctgttgtacattagatctctagacacactgattctttttttttttttttttttttttttgagacggagtttcagtcttgtcactcaggctggagttcagtggcgcaatctcggctcactgcaacttctgcctcctgggttcagatgattctcctgcctcagcctgccgagtagctgggattacaggcatgcaccaccatgcccggctaacttttatattttgggtagagacagggtttcaccatgttggccaggctggtctcaaactcctggcctcaggtgatccgcctgccttggcctcccaaagttctgggattacaggagtgagccaccatgcctggcctagacatacagattctacatgattacaagtttgttccctctcatctactttccattttctcctctccctgcccctggtaaccaccattctactctctgtttctatgtatttgatttttttttttttttaagattctacatgtaagtaagatcgtgcagtagttttgtttctatgtctggcttatagttcacttagcaggttcattcatgttgttgcaaatgctagaatctcctttttaggttggataattattccattgtgtatctataccacaatttatttaccgcttcatctgttaatggattcttaggttgttttcatatcttggctattgtgaataatgctgcaatgaacgtcaaagtgcagatatgtccatgaggtgtttatttcatctcttttgggcatacccagaagagggattgctggatcatatggtagcagaatgttttatttggaagggaaacttttatactgttttccataatggctataacaatttgcattccctctgaaagtggacaagggttccctttattctacactctcaccaacacttgttatctcttgacttttttatacgagtcagtgtaactttaaatccacctggcctgatgctaaattatgaatgggaaaaattatattaatacttagaatcctgactgggtgcagtggcttatgcctggaaccatagcactttgggaggctgagatgggaggatcacttgagccaggagttcgagaccagccagggcaacatagtgagacctcatctctctaaaaaataaaatattagcctagtttggtggcacatgcctgtagtcccagctactcaggaggctgaggtgtaaggatcacttgagcccaggaggtcaaggctacggtaagccatgattgcactactgtactctagcctgggtaacaaagcaaagcaagaccatcttcacacacacacacgaaaaaaacttagaattctttttttttttttttttttttttttttttttttttttttgggggagggtctcattctgttgccaggctggagtgcagtggcgatcttggctcactgcaacctctgactcccaggttcaagtgattctcctgcctcagcctcccgagtagctgggattacaggtgcctgccaccatgaccagctaattttttttgtatttttagtagagacggagtttcaccgtgttggccaggatggtctcgatctcctgacctcgtgatcctcccgcctcagtcccccagagtgctgggattacaggcgtgagccatcacgcctggctaaacttagaattctttacattcaaataatgtctggtatttttttacattattttcatgtatattccctaatttaaacttatccccacccccccccaccccaccatgatgtcgtcaacacagaactgttttctagattaggaaactgaggatagggattttaagtatctcgctcctagatcaggaccgcatccaggttgcagaatcccaatccagcactcttccacatagtcacagcactaccccaactctaatctactgatgacacagaacaaaattaaagtccttgtccaaatcccagagttcatgaacacagagatgttaatgctcctgtagttcatactgcaaaaagaatgtgagagcttgtttcatttttcacttagaaaatgtatgagatgttctttctgaaggggttctgtcactaacaggttgcattacttgtacaaccattatatctgaatcttcccagaccgtggtttttttttgtttgtttgttttgttttttattaaatactgtcattaaaccagaactcatggatatctatgtcatttccagctataaaattctagaaacttggggattttacctttttgtttcttattttattttcttttttatcaaaagccttatcacaggtaaaatggtaatctaagcaagaataagctctgtcatgatttatgaagcatggaaattcagctgtggccaggcacagtggctcacatctgtaatcccggcactttgggaggccgaggtgggtggatcacttgaggccaggagttcgagaccagcctggcccacatggtgaaaacccgtctctactaaaaatacaaaaattagctgggtttggtggtgtgtgcctgtagtcccagctacccaggaggctgaagcaagagaatcgcttgaatctgggaggcggaggttgcagtctttagcatgggtgacagagtgagattctgtcttagaaacaacaacaacaacaacaaaaaccaacaacaagcacaaaccaataatagaaactttaaatgattctgagccttgagaggaatgtgattatgcaacctgggaaattcacctgcccatgaatagtatctctgtaattaataacaaagtcttacaggacagtccttgccatcaccatatcataaacgtatattgcttcttttagttcataggaacagggtctcctgctgtgtcatagctgtaggatttagcctaaatgctcagtgagtttgatgctcccttgagcaagcccgcttatttaagaaagtagtttttggatattcatggtttattgctgacagttaacgttctcaaaatagtgagagtcctaaagtcaaaggggaatttattaacaattttatttctgagaggatatgacaacaacaaagacattaataaaaaacaccagcgagctttctggcaatatgtattaaaattttcaaaaacacttatactctcgaatccagcagttattatttcgggaaattgctctaagaatattatctttttatacaaagcattttctgaagagaagtattcaggaaattttcatttatgaacagaaaaagtccaacattatggaaatagtgatataaaatacagcatatatagttctttggtattttacagtcatgtaatcatggagagaaatacttcagataaattaacataataaaccacaatacaaaaaagtatatttacaatagaaaaaaagtttaaaagtgtgttagcaatacaaataaacaaatacaagaaggatctatcacaacaatgctacagtgatgagccttcagataattttcattatttttcttgatacttctatatgttcaaaactttcattaatgagcctgtaataccagcactttgggaggccgagatgggctgatcgcttgagctcagtagttcaagaccaagctaggcaacatggcgagactccatctttacaaataatacatacatacataagtaactaagtaagtaaattagccaggcatagtggtatgttcctgtacttccagctacttggagggctaaggcaggaggattgcttgagcccaggaggtcaaggctgcagtgagccatgtttatacccctgcaatccagcttgagtgacagagtgagaccctatttcaaaaaacaaaatttcactgatgacaataaatattaccttgacatcaaaaaaaaaaaaaaaatccagtgcctggatgatcacccagtagcatctaaaagtgcatttgaatatatatccaggttctgatgccagcattgatgcttgttatgtgacaaaaagaaatcacctaactgctttgggcttccatttcttcaaagtaaaatgaagtggttaaacaggattactccccagatgtctccccaaactttacactggtgtaataattgtttgcaaggatcattgggtgattatgtctaaaagcctgcagttattagtcctcatatcaggaatgtgctatccccattcattttattgtagaacctggtttgctgtgggatagttgaaatttgaagaattcacttggtcagtgtgtttcacggccttgctactttttctgcttggatggactcacttctctatatgattttctctttaaatcagaagtatttgacctgaagcagtaactcctctattcatataatagtgatattctgatacatatgtgaatattataaaaataagtagaatgataatattattactaatattattgtggcagtaataatattatcattcacatgtgatcaatagtaaaagcacacacagcaacccctcaggatttcatcctcaggccattgactcccatcacctttactgatatttagcttagctttacaatcctcccctttgaaaaattcatattttaaccttgcctcccataaagacacacattttttcagatatagaatttgcaaggctgagacatatctttttagaatgaacccaatataaacacaaagcaacataggagaaaagtactagttacatgcccatggcaagaaaatatgcctgaaatggttctgtttattttgttgttgttgtttctgcttggaatttcagcagttatttggcaaagtgattagctagctgggaaggaagaaagctcgtctccatcagccttttgtcagagcccgccttttggtcccggagcccccatgaaagtgtgctgtagaccaggaccactgttgccctgaatgcatgagtatgcagcctttttatcgtaggcttgtcatctcctgagttctgcaatagatgccatgtgaaatccagtatatactcagtctaacacatagctgctgcataagaaaatttctttccatgcttaagcaatttctgcatagagcttaattcatagaaatcacttattcattcaaaaagcattcactgagttcctagtaggggccacatattacgctaaagtagatacaaggataaaccaaatgtagatctgtcctttaaagagtataacatgtagggaacaactacactctacatggcaatagaaagtcacaagtgggtgagaaccacaggagagaaacagtcagagggtgatgacagccagaactggtatgatgtgaaaggtcaatgacatcagaaacggcctcagggattttatagcctggctccttcaatttcagttcttggtataggccagcttttcaggactgttgattgtccctcttctttgtgtgaaattcctagtgcacagagcttctgcagtgcctcttaggtactttgaaaatcccaacgataaacatctggacccaacacagaagcctccaggaagctgtcttgttggcagtcacctacgagcaggcgataaacacaacacattaaatagtatgtaatgctccagggattgcagtcctctgcctcctaatctctctgtcctttcctcttttattgacttgtcaggagcatgacagttgtgcacaaccattagcacacaagaaatgactttcctgtgggggtgatggggactggggaacctactctttgagatagaaagttaccctgatgcagaataattacagtccagcttagcctccttataagcgattaatcttacttttcctcttagcttctgtctgtttgtaacctgaggttgaccgaagttagttcttttagttggttcttgagaaaaccctttcagtctgtatttccaggaataaatcttaactctaatttaaaaaacaaaagggccctataaatagttacttcaaaccctttaatttatagctgcattctcaatgtcttcatcctcccaaaatcactcacctctacatttttgccctaagtacctaggttagcacaacttttcacaacttctctttaacatttctctgaataacgtgaaccttccttatttccttaaaatataaacttatatatgttcttcctaggagattttcaacttttctgttctccacttattactctattcactctgttctctatctgagctgtcactaattagtatctacttaaataaatatttgagcaatttaacattacagttttttttttttttttcagcaagaagtgtgttcattatccattaaaagcctgggagagggactactaatgttacaccatcaatatctatttttagccacttcggttttggaagtgtctcttcttttggaagtgggagaccaagtggaggggaagaacatgaacaagggattgaagccattgagaaagtcatttattcattcgatagatatcttctgagcactgcgctaggacctaaggacagaataatgaaggcagagtttatccttccactagcacagcagtcaaaaccaataggaattaagattgtcagaagtgacaaaactgtacatagacctgttcacataactaacaagggaaacgatggaggtgatgtggaagtctgaacgtggtgcaggaataactcagccaacatccccctcctttgggaaatttagatagatgtaggtagattgagaagtgatataacagtcatgtggcatcattgagagagtcagttttctataatgacaaagacatggaaagagagatgtttagtacatgtacagcagaaggagttgattcacaacgcaatggaaacagaagtcaagaagacagtgaagtggatgaagcaaggagaaatcataaaaacaagcacactgggactgtcggacctcaggggagagtgacgtggatggtaaaccaagtttggggccagagaaaagtgaaagcttgtgctgttcttgttggtagtcatgggcaggctgtagcagggttattattaaaactctgatcccccaagtccaactgaaggggctccagtcactaccccatcatctcagtggtgagatgtagtcaaggcatctaacctctctgcctcagtttcctcatatgtaaaatagagacaatcattataaagtgtttagcagaatgccagatccacagtaaatatcagtaaaaggaaatttataaatttgtaaattgttagggaatggggtgagaccctcaagattctaatcttcaagggaaagaggatgctaaggaaagtcagaggaagcccgagaatcctaagagaggatgatacaagcaaattaattaaggaataagatcaaagaatattgggaaatgtttaatccacttggtgtgggaaaaggacttttttgtttgtttgtttttgagacggagtcttgctctgtcgcccaggctggactgcagtggtgcgttctcggctcactgcaagctccgtctccctggttcaagcgattctcctgcctcagcctcccgagtagctgggattacaggcgccagccacaacgcccacgcccagctaattttttttttttttttttttgtagtagagacggggtttcaccatgttggccagattggtcttgatctcctgacttcatgtgatccgcccgcctcggcctcccgaagtgctgggattacaggcgtgagccactgagcccggccgaaaaggactcttttttttttttttttacacagagtctcgctctgttgcccaggctggagtgcagtggcgccatctcggctcactgcaagctccgcctcccgggttcacgccattctcctgcctcagcctccagagtagctgggactacaggcgcccgccaccacacccggctaatttatttatttttttctttttttcttttttgtatttttaatagagacggggtttcaccgtgttagccaggatggtctccgtctcctgacctcatgatccgcctccctcagccttccaaagtactgggattacaggcgtgagccaccgcgcccgaccatgaaaaggactctttttaacctcttctccatgtctaatctgagtttcaacctttttattcttattctgttataagtacttctcccattcaagagcatataaaactagaattactttgggatgagtgtgagtgggggagagagaaggttgggagatcactagttgtgtttgctggtactgaatcctaccctaatacttccgaaatgaacctcattggataactcaactcttcattatgtttttgctaatcttttaggagcctttttgcaacccaccgtctccctaccctcgttgggtctttttttttttcttcttcagtcagggttttgctctgtaacccagtggggaaagtggcatgatgatggctcactgcagcctcaaattcctggactcaagctattttcccgccttaccttcctgagcagctgggactataggcgcatgccatcatgcgtggctaatttctaaaaaatatatatttttgtagagacatctctctatgttgcatttctggtcttgaactcctaggcgcaagcaatcctcccacctcagcctcccagagtgctggggattgcaggctgtttaatagaagttatcaacatatggagtcatttatgtctattgaaatatgaacagccaattcccttcacttgtcccatttctaattcagacactaattctgtttcagtttaacttggatcaatggacttatctttgcttctgttcagttatctgtttcaacaacaataagattctttatctatatggcatagtgggtgaaaggacacactaaccttacctactgctccttttatgtcagaaaatccattttctaatcactttttcttggacccaagtgagtctgttttttcccctacattttgtaatttgtcacatttacattttaggtgggttgttctaatcgacttttcttataaaagggtagtggttctagatcaatcgccatcaatcatgctaccaagcaatggtgaagtaccctttttaaaatattttatttagaagaatttcttatttcagatacaacagatgatacaagttgaatctagtagggtttagtaagagacaataaacatattaaacaaagccttacgtattttttaaggtgaaaaaaatcccccaagatagagtccgtgcttagaaactacccctgttaaatacttaatatataacatttgtaatgttcaaataccgaaagaaaaaaatgtacttgttcagagtctattcttgagtcaacctaccttctcagctctactgaccccaaacaaggtaaacaagctgatttaagttacaactaacttaaaaattatacatctaactcttttgtaaataactttagggctggtgctcaaaataattggaactagctatgaaaagaaagctagaaatgagaatgaggaaaattggtagtaagtgtctatagagaagtgtggaccatctgcaattcctatatttaaacagggagaagagggagatggggactcactctctccctcacaaccacatgactaaactggcccagccaatatctcatcaggtgtctccaccactttacaaagccactgggaatttatcaagggataaatacaaaactggtgtagggagaggggaatgggaagttacttccaaagactctgaccctgagttcttggcgtttattcttttttttgagacagtctcactctgtcgcccaggctagagtgcagtggcgcgatatcaactcactgcaacctctacccctgggttccagtgattctccagcctcagcctcctgattagctgggattacagacacccgccatgacaccctgctaatttttgtaattttagtagagacagggtttcaacatattggtcaggctggtctcgaactcctgacctcaggtgatccacccaccttggtctctcaaagtgctgggattacaggtgtgagccaccgtgcccggcccttggcctttattctttattttccctgatattaatccctaatgaaatgcatttagtacacattcatctttttaaaatgtgcagtttttgtcacagaagtagtgtaaaggacaccagaatggttggaagacgatttttgtggtcttctacaagtcctgttttggtgactctgagcaagtcttaaccttgcctacatttcctcacatttagggcaagtgtactcttcagggtcaactgcaatatctgtgggagtgctttgtgttttgtagcatgcatcttactagtgcttttgttgttgtttgcgttgtcgtgcgggttccccacctcccccataacactgtaaagaaatgctgagactaagtggtagggagtggcagccatctggtgaggatggaaagttaatatctttatttatgtaataaacctccctttagaattctgttactgtcaaatttctcctggaattctaatagtattttcgctatgtgttttgaccttttgctattgggaagacacaagtttatgaatgacaaatgggtaggggaatttaggctgcacagttaagtaggaagaatgaagtctttgctagagttagaatccagtttgaccttgaacaagttactcaatgactaagctccatttgcaaaatcgttttgttaaagggattagaggtaacatatctacatatgtacatgtgtacagtggtatggagaatggactggatgaatgcgtgctgttaccaatgtgataattactattctttttaaaaatagagtattttatgcatacacaatacttattcaattcaatttgccttagtgcacagtgatggaattttagaactggaattgacttcagaaataatctggtaaacgaaatcttttcgaggctcttcattttatggttgaggaaactaacatcctgagagctaaaagtcatcgttttcctttaaaatatctaaataatcccagatgttggatcagaactccaaagtcataatcagggcttttcctatttctatagtatttctaatactataacatgctattgctcagtcttttattctctaattccatcctggtttctagaccaaatatacctaattgtattctaacccacaagtacctcatcaatgagaagtctgacctatggtttatgatttccgcagacttaaatcaaccctgggcttctatccttatactagttttattttatgttttttgtttgtctttagagaaatgatcgtgttctgtcatccaggctggagtgcagggacataatcacagctcactgcagcctcaaactcctgggctccattgatcttcctgcttcaacctgctgagtagctaggactacaggcacgcaccatcaggcccaactacatttttaaatttttttctagagacgatgtctcgccatgtttcccaagctggtcttgaaccctggcctcaagcaatcctcccacctcagcttccctaagtaccaggattacaggcataagccactgagcccagccccacccttacatgttttctcttggcatcctgatccctggacacaaccccattgagatacccttccatttaatacttttcttagtcatttaccaaatgtgtttatagtaatatattcccatatatttgtggcagagtacagcactcatataaattttgatgaacacagacatgctgtcccatacttgtaggtaaaacaatcatgtgaaattaaaataaatattttgtttagatagatcttgactatcatacacttattctaacaatattgcccattcctcaaaacattctgggaactccttgaaataaaactgactatggtaagaagagtttttctgggagttgggaaactgattccattagaaggcagatggtgatagtctcacagcacactctctcccatgcggtctctattctacaggcatgcagatatttccaaaagcatcccttccctccagggtcctgaagaccctacctctggttctgccttggactgctctcagtgatattccctttttttttttttttttggacggagtctcactctgccgccaggctggagggcagtggcaccatcttggctcactgcaacctccgcctcccaggttcaagtgattctcctgcctcagcctcccaagtagctgggactacaggcacgtgccaccacgcctagctaatttttgtgtgtgtgtgtgttttttttagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactctactggtatggcctcatttgtcgatttgaggattattggtttatttatgcaaagcacataggatcataggattgctctctaggagaatggagtaattaataccatgaagactcatagacaatgcttcctcccctagaaactcattatttttcgaattttggcactgatctttcctgcctacttcctggcttttactaccttgtgaaaaagccccaagtgttagaagcagcttccccagcttactgccatcccttctaaggtccctggacaccactgcttgtctcctaccttagaaagtgcctacttggccaggcacgctggctcacgcctgtaatcctagaactttgggaggctgaggcaggaggatcacgaggtcaagagatcgagaccatcctggccaacatggtgaaaccccagctctactaaaaatacaaaaattagctgggtgtggtggggcatgcctgtagtctcagctacttgggaggctgaggtaggagattcacttgaagccgggaggtggaggttgcagtgacctgagatcacgccactgcactccagcctggtgacagagagagactctgtctcaaaaaaaaaaaaaaaaagtgcctactcataccctcctcctatttattctgatttctgtgcatgtattctttttgtttgtttgtttttcagagacaaggtcttgctctgtcacctaggctggagtgcagtggcacagtggcatgaccatagctcactacagcctcaaactactcctgggctcaaaatgatccccctgcctcacctaccaagtagctgagactacaggcaaatgccaccatgcctagcctgtgcctgttttcttaaggcagaaatgatctaaaagtgtggcagagggaaaagaagatgggacttagagcttaaataaatctagatgaaaatgttggttctatcactcacaggttctgtgatgttagggaagttaagttatttgcaataaaaattattaatattgtagaacatgtattgatcctatgtatcaggcttgaattaggtgctttaagtgggttgtctcaattaattcatcactctgattttcaattttctgttctaagaaatgagatcaaatatgcctatcttgccgaagagtagtaaaaattagacaggtagctgcctctggatcctgcagggtagagaaagtattacatatctgcatgtgtggatgtgaaggacacacagatacataaggtaaatgagaatttattataaaggtgtatttgacaaaaattggggaaaaaaggaaaattggagaagatatctttctgtgagattaaagacaaataggggaaaaaagggaccaatgacaagaattagagcaaggtatgtaaagaattccagagctggctctaagagatagagcagctggtcatatatgaaagggatgattcattcttcaggggctatccctcgtgatcctatttccttgcacaagctatcagttaatttattgattcacctcctttatgtgctcataggcatcaagaatacaatggatcacatacaattacagaaaagtttcatttcaggaggtcaaacaggaagtttctttctgacttatattgaagtactcatgatgacaatggagaaaaatgaacataatcttttatgggtggggaccatgtgatctcttttctttcaagctccagagggtttataagacatttccatgttcaatttgattccggaaattatatgttgggtagaacagactctttttggcaactcatgagaattgccaatgatcccagcatttgctactcttgatagtaattcccttcatttcctccatttttatacatgacctgcagtaaatattgacagttactttgctggaaagaataacacagagacagcttttcttaagctccaaactgaatttcgtggttaattgattggccagctggccctgccgtctcttgacctctacaagagccagcaagattgatggtttcagcagcctttcatggtgcactaaagcattcagatctatcttttgttatttgggaaacactaagttcttatgtagcacattatttacatggactcaagggctgacgagctgggaggcagcaaatgcccaaatggaagacaatgtatgtagatcaaagaagccgatgagacagagagttcataaaatgtgaatacaattccaggggagaattgatgattatggaagcagaaagccaattgagttaaatattcattccagcaacaagtctgatcgtctcactgggacctgtgcctttccgaagtttcctcagcttttcaaggtctacacaaggaaagaacaaagccatcaaggaggctctcattctggaaagccggctgcaagatggcatgaaccagaggtcagcggccaccactgagagttcatcgtattcgcctctgtaaagaataagcctcaagcagtggttctgcaggagcggttcagcatcatcaataccaatgagccctaatgaatgtgacaattcagaatgattgggccttttcctccaaaacgtttttctcctcaaaagtaaaacaggcttgaaactcatgtcttatatatgctgtttagattttcatatattaatgtcacgaatcagatgataggaaggtatattaacaagtgagacattgggatatggccccttgttcaagagcatcaaagcattaaatatgttgttttaaaaatacctttggcatagttttaccacctatttctcaattgccatcaaaattttaacttttaatgacttttggaagtaggttagatggggtggtgggagaggaatagaggatacagaaagataaaaactaaatccaaaaatagtattgaatgagaattactaataagaattattaattgagtgtcttctcataaaaatagtaatatctgttctttggtctctcacaatacatagtttaactccatatataatttaatgaatgcaatgtgtcactttggttataggtttgcatcttggaaacgatgttagtagaaacaagtcagtttccctctgttcctttttgcttagctttctgggctatcttcaccaatgccacagtccatctgtaacagaatgcattggagatttgaaaaatcacgacagataataaatctctatatacttctcatcctctggaacaattgagacattgaaattgcctgatctttttgagtgagtgttgccactttgacccaggcaaatgagaaataaaacaacaataccaaccagcagtttcaagtatccttctgctgcataataactcagcagtaggctttgctaatggtgtttatgagctgccaggctagaattggcccttaagcagggaggcatttgcccagtgggcttcttccatgtgggggggcctttttgcagcctgggggcccttttaggtgattctcagccggagcggtctcttcaggccaaagacttttgcaatgagctaactatgttcaattattgctttcagatccaccctacattcaaatgttttgggacaccaatgtaataccataaaaatgactgtgtaggacacgcctatgctaatgtcatgactggtttgttttacgtattatttatttatttgatactgttaataaaaagcaaacaagccaaaaagaaatactccccaacgtttaatagagatcattgtatcctaaaatcttatagcacattagagtgcaatgaagctcaatgtaacaagcatcaacaatcaactacgaaatgagtatggaaatagagtatatccaaggaagacagaagtgtagaccacatgatgacagcgggataaagacaaaggagaaggtaatcgagagccaagggttaaaccattcaaattgtcctttggcattaaaatgatccaagatgtttcatgagttcaggttaaaaaaggaaatcagtaaaccccaatatactttaagtttcatttgacgcccacaagctgaaactacctctttgtggtgtgtgtctttacatcagcaaagagtataattgaatttggttattatctccagtgctacctgtttggacctgctatttcaccttcctgaaaactgttgcattgagttctactggggaaaattcttaagataacatctgtttactaagaagggggtgtgcttacctgctctaaggtattgaaatacattgtaaatctatacctaattcatataaacataatttcaaggaaaaacaaaaacataagagacagaccctggcggagtgccaaagaatttgtcagggtcccagtccctgtaccttatgggagaattaaattcattaaactgggccagatgtggtggctcacactggtaatctcagcactttgggaggctgaggcaggtggatcacctgaggtcaggagcttgagaccagcctggccaacatggtgaaaccccatctctactaaaaataaaaaaaattagtcaagcttggtggtaggtgcctgtaatcccagctagtcaggaggctgaggcaggagagtcgcttgaacctgggaggcagaggttgcagtgagccgagatcgtaccactgcactctagcctgggcgacagaatgagactcagtctccaaaaaataaataaataaattcattaaactgaacaaattgagcccaatttatttgtcatagttcaaagaaaaggagagagtagagtaaaggggcttagtgcaaatgtctggtcagatactcaaaggtttagagcctcttaacccttatatttctttacataatttattctcattattttttgtttgttttttgagacagagccctgctctgtcatcagtctggagtacagtggcgcgatctcagctcactgcaatccctgcctcctgggttcaagtgattcccctgcctcagcctcccgagtagctgggactacaggcatgcatcaccatgcccagctaattttttctattttggcagggatagggtttcaccaggttggccaggatggtctcaatctcctgaccttgtgatgtacccaccttggcctcccaaagcgctgggattacaggtgtgagccaccacgcccagcccattcttgtttcttggtaaaggaaaatccaactatatatatcttctttaggatcacttaaagacccatacagatctgtcaaatagacatccaatattttggtaggctttgaaaggaggtgcaaaaggatgagaaggaatttagggagatcattatctgaatcattgaacaaatgctccttaagcacctggtgaagagaggctactgagaagcagagcacgtggtcccagcctacgaggtgacaaagtaaaatggcagaagcaatttgtaatgatctcacctatatgtggaatctaaaaaaaagtcagcctcatggaaacagtagaaaggtgattaccaggtctgggggctaggagagagatagggaaggggaaatgctgtcaaaggatccaaagtttcagttagacagaaaaaataaacttcagtgatctattgcacagcatggtgaccacagttaaaaataatgtatggtacatctccaaattgcttaaaaaaaaaaaaaaggtttcaaatgttgtcaccacagaaaaacaaaaacaaaaacaaaaaaaacaaaaaaaacgaggcaaggtgatggagatgttaattagcttgatttaaccttcctacaatgtatatgtgttagtccgtttttgcgttgctgtaaagaagtatctgaggctaggtaatttgtaaagaaaagtggcttattttggctcatggttctgtagactataaaggtagcgtggtgctagcatctgcttttggtgagggctcagaaagcttccaatcatggcagaaggcaaagggggagcccacatatcagatggtgagagggagcaagagttgagggggaggtgccacgctcttttaaacaaccagatctcatatgaactcagagcaagaactcactcattatcgtgagaacaacaccacgctattcacaagggatccacccccatgaccaaaacacctcccactgggccccacttccaacactgcgggttacatttcaacatgagatttaaaaccatgtcagtatacatacatacattaaaatatgcatcacattgtgccctatacacatataaattattgtttgtcaattaaagaaagaaataattttaaaataaataggccaggcgcagtggctgatgcctataatccaagcactttgggaggccaaggcaggcagattccttgagcccaggagttcaagagcagcctgggcaacatgatgaaatctcatctctaaaaaaatacaaaaattagctgggtatgtggggggtgcacaggtagtcccagctactcaagaggctgaggtggggggattgcttgagcctggcaggcggaggttgcagtgagattgcaccactgcacaccagcctgggtaacccattgagaacctgtcttaataaataaataaataaataaacaaacaaataaaggttgtgttagaacaaaaaagaaaaagagtgacaatgcaagccacatagttgaagttgacattaactagcatgtgccaacgagtgacaaaggaaacaagtgcaaagcaagaaaagttagccattatcatggtccatagataatactctcaaccccggctcttgagtgaagcagtattgtgcagtggttacatttatggacctaatggtcaaactgcatgagttcaaatcccagctttacagctaatggttgcattatcttgggcaagtcatttaacatctctgccttaattgattcacctctaatatagagctgataggagtctgaaatagctgctataaggactaaatacattaatatatagatagcattcataacagtgttttgtggactttccgaaggtgctgggccttccagttgccttaaagaatggattggattagggtggaggagatgaaaaaaggcatcacagtacatcaagtgaatggtgccagtgtaagtagaatacaggaataaggaaatgcccagcttgttggggggttagtatgaagacctctaactgggactgaaagttctagcaacagtaaaataccctggcctccaactactaagtaccctgaatactaagatgagtttatttttcattctatagacaatttccatctctttctttcaaaacaaacaaatgatgacgctgtatgagtaacagaagatgactgggaacagaaccgtgaacagaattaagcacctgcaatcaaataaaattcacagaaaacttaatttaccacattagtgatatgcataatcgttgttgtgctggtaaccagctcttcaggaaaaaaaaaagaaaattcctgatttgttaaaatactgtcactatggcccactgaaactatcaaaatgaggcatataacaggaaattgggaggagagttatacaatcagctcttgctagaaaatgatgatcattgacattacccttatggaaccaatccaaatttgggggttgttttctttctttctacttttgtgtgtgtgtgtgtgtgtgtgtgtgttctctggtatctgtaaataacatccatatcagtttctccatccattctttgcacatcactggtaatgcctgagatcaaatctgccatgcttttccgggcagatccaggctgggatctcagtatccctgcttccctgaagctgtccaacctcactcccttcattgctctgctgtgattaggaaggagccattccaaggactatggggtgctctgtgggataagcccagtccttcttccatacaggaggaacaggggacgggtgctgacaagaggaaatgcatggagcagagagagggaacaggcagatggactcaaggtccccagactctttcgagtgttgaatcagaaggactggagctgtgggggaagagggtgggaacagggtagtggaataacatgcagacagatgggctgaactgaaggtccagaggcactcccagccgtcaaccagcagttcttacaccaggttgatgttagggaacaaccccagctttaaaacttatttataccaaagtgccaaatgactcatttgagacaaggctttgatctctggggacagggcgttagacagcatgaggcttaggttgccaggtgtcttcccacagttcctgtcttgtgtatgttacacactcaattcatgtcaggatgacactacattggcatgatccaagggaacccataactgacatgaatatgtgtgtgtgtgttgattggggagatgggaaagagaacatttcttccagattttctagttcttatagttcataatcttaatcctcatctccacttctctgccacttctctggctaaatccaaagcacagcctggctagagaggacttctcttccttgggggttctagtctattctctgagttgtgacaaacatttccattccctgtaattacccacttgccttgtctctgaagaggcattcacagaataaaccaaaagaattgtagtgttaggaagatgtcaaatcatttgacctctactccatctccggcttttccttctccccccatgaaagttatgcatttagttgcctcttgttcattagtctggacttagagcaaagtgactacttcaacttcttgtgctcaacatatgccacagttgcttacatgtgataagtccatttgtcacttgataagcctttgctagaatttccttctctccatctccaaccttataatgatcttgaaggcaatgtcggaggctaggtaagtcttctttgtgttccccacttgagcataggtgagctgtcatgtcaatttccttacactactgagaagaggggatgtgggtgggcagggacccccagaaacaactttacccctttcacagtttccatcactgcctccaatgtccaccgacgttagaaagtttgggcagaagtggccaggtgcggtggctcacgcctgtaatcccagcactttggggggccgaggcgggcagatcacaagctcaggagatcgagaccatcctggctaacatggtgaaaacccgtctctactaaaaatacaaaaattagccaggcgtggtgtcaggcgcctgcagtcccagctactagggaggctgaggcagaagaatggcatgaacccaggaggcggagcttgcagtgagccaagatcgcaccactgcactccagcctgggcgacagagcaagactccgtatcaaaaaaaaaaaaaagaaagtttgggcaaaacctagagtttcagggaaagtcatttgaggtttggtttaggcaggaaatagaacaaaaccagtgtactaaggagaatacagtggaaataagagggaaaggaatgaagaaactggtaggctactaaaatgcccaggtacaaactactgaacatccacctttatgctgtcagtgggcagaaaaagaaatagacaatgacaagatacattttgaattagtgtgatttaaggactggctgatgtgcacaaaacatgagagaagggagtcaactttgacagagatttcaagagcagatcactgatgaaatgtgataacattcagaaaatagagaagttgacatgggctttgatgaaaacacaatgagttcagtttgaagcattttgaagtcaaggtgattttgtgaaatacaaacgatgctgtccagcaggcatagaatctatctggagtcatttgtacaatatacctatgccttttttttttctttctcctactgtagacttagataggaactcacttttgtcttttttctgctaggccaataaatacgttctcagcttagaaaaggggctttttggtttgcctatttctgtttctttttacagaagttaacacatttatttgtgacctattaaaatcatgaagtattaccactgggttttatgttttaatggaaacatttcatgtttagagaataatgatgcttaaaatttatatgaattaaaattttagcctgtaaaaagagcctggaaatatcttcataccatcatctatccttccacttaaatattaatcacaaagaagatcaggcgtagtgaacatacaccacgcaacctcccattcagagaattcttgtgcaaagaaggattccaaagggtttcagaaatactaaacttcttgaaattgaaattgaaattgaaatccttcttggcttctctacctgttacttcctctgcagtgctcagtatagtgtctgctctccctcctttctttttctttttttttgagacagattttcactcttgttgcctaggctggagtgtaatggcgcaatcttggctcaccgcaacctctgcctcttgggttcaagcgatactcctgcctcagcctcccaaggagctgggattatagtaccacgcccagctaattttgtcttttcagtagagatggggtttctccatgttggtcaggctggtctccaactcctgacctctggtgatcctccctcctcggcctcccaaagtgctgggattactggcgtgagccacacacccggtctgctctccctcctttcttcacttttctgcttcctctctcatattaataataagcttctatctttccttaattgtttacatatctgtctgtcctctttctccaccccacgaactcctcaaaggcagagtccctgtcttttttatttcatatccctaatggtagctgcaaagcagacactcaagaaggaaggaaggaagtaggtgggagaaaggaagaagaaaggaaaatgaaattaactactagtttgtttccctgtttcattgagaacacacgtattaaccaaacaagtaaacaattgtcagaatattgcattttaaactcctgagagaagttgctgcttctgtggcatttctatctaattaagtttccccttaaagttgtaatcttttctttcaaatctcataatacgtcttatttaggtgatcataccaattatatctttcccactcaaacccctaaagttatccttgaataaatgagccttgcaaattatatttccccaatttgcacttatttctttcttttttttcttttttctttgagacagagtttcactcttattgcccaggttggagtgcaatggagtgatctcagctcactgcaacctccgcctcctgggtttaagcaattctcctgcctcagcctcccaagtagctgggattacaggcgctccccccctccccatgcctggctaattttttatatttttagtagacagggttttgccgtgttggccaggctggtctcaaactcctgacctcaagggatctgcccacttcggcctcccaaagtgctgggattacagatgtgagccaccgcacccagcctcagaatttcttactgaataatccttttatagtttgttataactaacacaaaacagtagtgggagttcttattcagatagctaacaaattccaggcacctcctgtactataagtgtccctcatagcacaaaggggaaagctgccctttaagaatccataaatgcaatgaaactctacttacgccacccaggttgttaggacacaggaatattaatctggagaagcctttgataatagaatatagtcaaagttgacattgtgctagaatatttgaattttttattttccagaaattattttcactctttgctacatttactgtttgacctcaaaagaatgtaaaagcaagtttttaaatacaccattatttcctcaagaggctacagaattgctggatttttttttttttttggaatggagtcttgctctgccacccaggctggagtgcagtggcatgaccttggcacactgcaacctccacctcctgggttcaagcagttctcttacctcagcctcctgagtagctgagattacaggtgtgtgctcccatgcctggctaatttttgtatttttagtagaggtggggtttcgccatgttggccaggctggtctcaaattcctgacctcaagcaattcacttgccacagcctcccaaagtgctgggactacatgtgtgagccactgtgcccaacccagaattgctggaacttaatgccaactctcaattgtctttccttctgctagatctagttaatagcaggtgtctgatacatgttactgaagtgaatatgaaaaatccagagtaagcaaataaatcatatttttttaattaaaaacatataaagtacatttttgtcaaatgaacctaattggcaaagcaaaatctcatcttttaaatttctgagtttccactattgataaaaaaaaaaaaaataacgtaaaacagtgttggattttcaaactcaaaagaaagaaaaaaaccacaaaaaacaaaaaaagcagaagttgggtaaaaacgagttctgactaaaagctgcaatactgtctcaaatgtgcccatgaccccacctattgctcaatttctacaccatgagggtaaagggaaacgaaatgcaacttggattcacttgacttcttaagtcttacagagagagaaactgatcagaaaagatacatttttggaggttggtttttttttttaattcttgcttgtaaggcagggcttggtgactcctggtctcctccaatagcctaattttcctcccaaaagtaagcttttgattccactagggtgggcaagtatctttgtactctgccatttcagagataagagccaactgattttagaaatccaagagcaaatgaaatgtgcaacattttactcttggattgcttgagaccgcatctgtatgcctattccctggagtgcagactgtcttgtgagcatttggtgccactgaactctgaaaatcagggcatgcagcatctgctggggaacacaatctggtttctgtggatcagaagcatttctctacacgttagagtcttaaggatttttaaagagagcaggtctactcaggcaactcgttaccgtccctttcaaccggagtcagaactaagaatgctcagcagatggttgtggagtgaggtaaatttacatgcagccttcagtcattagtgacagatctattttaaagggacgaggttgtgcaacaagggtacaaaggcagctcatggttctaattgttgggctccattagaaggggtctttctggagactgtggtttcttagagcaccgcagtctacccctgaatgaaaggcatcctgctggctaattaacttgcagcactttcttctctattgtgccttgattttttgttttgtttggttttaatctcagaccttgtttctagtaggactgatggagtcttccattatttcgcctaaatattttatgaagaacagagtttccaatcactcactcactctgatttcattacttttagcatacttttcgttcttataatctgcaataaagaggaagactattaagattcaagcttgtttgagcaagtacactgccagagcaaaatcagaggaattcatggaagactgggaaggtgcaagtaatctttctcttagaattgtgatggtaacatatgaaataaaatgtgggagcaaatgaagccattgaaaagagaggccattatacttctgaccacttgggaaataccccccaaaatagctgaaaggtcccaagaggctgggcacagtggctcacatctgtaatcctagcactttgagaggccaaggcaggcagatcacttgagcccaggagtcagagaccagcttgggcaacatggcaaaaccccatctctacccaaacaaacaaacaaacaaacaaacaaactagccaggcatggtggcaactgcttgtagtctagctacagcttccatgaattgttcagtgatgctctcttaactccatgatctatggaacaggcaggcagaaatggagagacagtgggtggaggggaggagcctcagatggcacagaaatctgtagcatctagatcagagtgacacctcagagtttcgagtaacgacaggcacctggcccatggctgggattgttaccagtggtgaatctgtgcaggtctgcagcaacctcaattcttccctctttaggataaaaacttcattgaggggcataaagcagaagagactgaagcaagttttagagagggagtgaaagtttattaaaaagctttagagcaggaatgaaaagaaagtaaaatacacttggaagagggccaagcagacatcttggaggtcaagcacagggatttgaccttctgacttgggggtgtatatgctggcctatttccagcacttcacatcccttttcccttgattcttcctttaggatgggctgccgcatgtgtggtggcctgctagtgcttgggaagtgagcatgcgcagtgtgtttactggcgttgtacacatgctcacctgaggcgttcttcgggtgaatgcccccagaaagtcatgtaccagttaaactctgccatttggcctcttagtgcatatgtgtgagccccctgcccaactcctgggaccttatcgggaagctgataatcaccagtttcagatttttcctatttataaaaagactgcctttccctggagctggctgcaaccaattattttagagagacagttaccaaccacctgttcatcacttgatggtggcctgacattcctggttagggcggggggcactgtcctgctctgctcatgtctgcctacctactgtagcaggaccacaggcagacttttcttaaggagactcccagctttcttcctggtgaaggacccagagtttgtgagcccaggactgcagataatcaaaaatattaaattatggaagctaaatatttaaaataataactcataatggctctccaaatgtctgtaaaagcatttcacttaacaatagctggcaaatattatgtcagtggaaaatacagccaagttttggctcatccaaaatgttgtcatcaccgccactttaatatttaagagattaatgtttcaaggctcttccagaacattgtatttggagtctgattgaaagactcctcggtcctccctcattattctttatgtgtgactttggatgctctcaatacacttaaattgtatgtccctgtggggaatggttctcaaagtgtagtatctggagcagcagtatcagcttcacctgggaacttgttaaaaacataaattcttgcagctggatgtggtggcacatgcctataatcccaatgggagaccaaggtaggaggatatcttgagcttaggagtttgagactagcctgagcaacatagtgagaccccatctctataaaaaataaacaaaattagctggacacagtggtgtatgcctgtagttctagctacaggggagtctgaggtaggaggattgcttgaacccaggagttcaaggctgcagtgaactgatatcgcgccactgcactccagtctgagtgacagaacgagactctgtctcaaaaaaaaaaaaactgggggccacacaacagacatactgaatcagaagcctgggggtgtagctcagcttgtattttaacaaggcctccatgcaattctgatgtgccctccagttttagaattgatgctctgtgcaaatgaacaggtactggggcataatgatatgcaggactgttcttgagccaggctttgtattcatgaagtgggtgatagttgattggcattgtttcagtactcagtagctatgaagcattctattggtatcattggtattaaatatggagcagaagcataactcatctccctcatggccacatgaagaaagatcagtatgttagagctgaaggacacctaaagccccaaacaactgccagagaccaaaatcatttgtctcaagaaatgttaacaccctttttgtgttcaagttttattatttctttactaaaattgcccattcacccctttgttttatttttcacacctaaaaaagtagccaagtttgaaaaagaaagagtgcttgccaccctttctgtccttaaagtgaaggccttgtctatctcattctgatctctgcccatccatcaccattcagcactcctgttgtgacttcgccccatctccaatcttacattttattttcttggtacttttggtcatggctgtgttgatggtttcagaagaatacatagtatattaaggggtaacgtttacaaatgttcttgagagaactaatttttcccccttcatctcaaggtgtcactgcttaattattacggttcctaaataatctctatgatgtggttaactatccctaccttgcagaaatcctggaagatgagacggacctagcatgttgtgtgagcaacatctcttagagataatcaatttgatatcagcacaattattgtggctactattgaaatttctcttagtttcttagattagtactattggaactaatcgtaaataaccaatttacaagaaaatgagtctcattatattatagcacgaagaggatatattcaaggagatacacctttgaatctattatttcaatatgcttataaaaattactattttaataaatttcccagtcaatcctattgtgtagaaaaagatgcttcactgcttacatattttaagatgagactgggaacaagcagattaatttggttgtgagactgggagtttatgagcaaaatgttcttctgtgcaaacgaagtagaagcttcatttcccttcccttcagttaaccctatgttattggatacgtaccaggtactagagattctctccctgggtagtctggcttagaatggctccccaggctctagccatctgcatagctgctagaggaaaaagctgttttagttggctccaagaatgtctctgggaattataatgtattcatagaaatgagtgtggagtgcccacttgcacaatggaagatccacaataatacacctggatctgatagcaccttcctgaacttgggccacttccctctttgaggtttgtgaggccaaagggatatacacagaggctgcctttgtttgtgattacctgggaattagatggggtatcattcccccttatatccttttactatagcttgttcacttttgaaaaggtggaaaactagactaaattctgtattgaaaatgtcaagtcaaatatgctatataaccaagaaatatcagtatagaatatcatgtattctacacaaagctacattttcaatataatccccgtaattatttcactcatcaaagaaatgtatccagctgagacataaaaccttagtcaatacattaagaaaaaaagaaaaaaaaaaacatttttttcccagtcatggggaccagattgtgtctattattcatcagggcctagcacaatgttgagcacatgctcaaggtggccaataaatccttgtggaattgagttatatgggagtcaattattcggtcacagcactggattaggaggttgagttcttgatagatttactttcagctgacctgtgtgacatttggtatttggttttgcaactttgttttcagttttttccatgcaccaatactcctagaattttgcttttgcctcttttcttccctttcatcttttttttttttctgtagaaagcatacatccatatagaagacctctctcaatacattccagatctgagttgcagtgcagcacttagcttagcttgtgaaacactccaaagacttgattaatatcatcctatggagagatgtccttaagtaacttagaatggatcctttatttttccagtaaataaactctaaaatatgaggatttccaaggtgaaaagaaagagtacgaacccaagaaatattttaaatgaatcttgttttccgtccctgtgttctgagtaacatctgtattcacccctgcctttccattgattggaaacctttagtattctttgtactctcacagtcctagtttctcagaactgtctgtcccagtctaggcagttgtttcattaaacaaatgttattaaacaaataattttgagtgtgtgtctggtggggaggggaggctggggggttaaattcatgtatttttaggcaagagtattaacaagaattgtttgaaatatttctgaaaccatagtgtcataatgaaaataaaaataaggtggagactggattgtaattaacacagagcttttccatccaagacagagcttaaaggcctctgtttgttgggtcactttaaaaacaaaccctactgccagggatttccaatggcaactttaccgtgcttacccaaatggaggtaattaacaacccttctgtgtgttaaattaggtatccacagaattgggaagcttcagatatttattgtaaaccagagcctcttttcttgttaatctcctaagacagcagactagtgactcgcacccattagaacaaatgaactaagaaactgaatgacaggttctgaggcccctaagaagaaaaaacagagtctggattagagctgcttaacagaccactcactggggcatgctccctccccacgcccatttcctatcccagaaaataacaaacttcagatgacccgccaaaaacgactaccttttatatttgtcgttgaattatttcttctttgtttaaaattaaataatgcaagtgatttttttgctttagaaaggaggattacctcttcctagacatccagttgaaaaaccaactggtatagaagggaaatgcatctcaaacagatacaatgacattcttataattgcctcatttgaaatggcagcatttccccgtgctaattgtcatccttcagctaatttggtacattaaaggagattgttattaaaaacaaaattaaatccattgccagcatctttattctctaccagaagaaaaattttaaataaatgcaaatacgccagttttgctcttaatgttgcctgaagttgaaaggatgaactttgacttgaaagataatgagttccccctgttggaggatttgaggtttgggttggataatcccagatgatgttggaatagacagaatttaaggttccttctaaccctgaaattctatggttataaaatctatccttttcttgaaagaagaaatattaaaggtgttttcaaggaaatggtagcataatgaaaaaggaaacacaaaaatgatttttttttccttaataagcagtcacctcacttggtaatagtttttcttcttaattgcttgtttgtttgtaacaaatgcggtggtgtaatcaagtggcttttacaataataaaacacttctctcaattaaactgtactgcaaggaattcaaagatgaacagaagtgttccttcttttaagatgctgatttataagcatccctttaaaatttacttctctttctgatgataaaagtaatacatgtttattgtagaacatttggaaactaccagggactataaataacccatagttgccccaccagagaatattcttaatatttttggcatatttcttccatatatctattcatattcacattcatactaatttgtcatattctaatttaaccctctctttaatgtttataatgtgattatactactttttaacacatgaattgtctccaaataaaagccaaagtgatccatttgttaattttttttaatcctacccagctgaaatggacaaagaggagcccatctcactcgggggaggggatcaaagagttatcctttctcttgatcaattctgtagcaatcagccatgataagaagcccaaattaccaaattaacaaaaagaattttatttagtggccatatataaaagctaaatggacagttggagacagacaacaaaaactaatataaaactaaaaatgtgaaaattcagcatttaatgaaaatgagagcttagaaaaactagcatccagatttattcagactgaatttctgccctgggaaattaatgaatcatccttcagttcccttttgtgtctgtgcatccagcctcattgtccttggtagtaaattatgtacaccccctgtttccaaatcttcaaatacggtatgcgtcataaagtcacaaaatgtgtaatttgggtcctgtatacaaattctagccagggaatggcttgtagtcatgctaaatattctttacaagttgtgtaacaaagacaaagaaaactacaaaaaaatacagagaaacataaaaaatttcccattccttctgtgattctgatgtatttccctttgattctttgcttctacattgaaatagacttagtgggtaatactaataattacagttaacagtgaccaggtgatatggtttgactaggtccccacccaaaatctcatcttgaactgtagctcccataattcgcacgtcatgggagggatcccgtcggaggtaattgaatcatgggggaaggtctttcctgtactgttcttgtgatagtcaataagtctcacgagatctggtggttttataaaggggagttcccctgcacatgctgtcttgcctgccaccatgtaagacgtgactttgttcctcttttgccttccaccatgattgtgaggcttccccagccatgtggaactgtgagtccattaaacctctttctttataaattactcagtcttgggtatgtctttgttgttgttgttgttttgagacagagtttcactcttgttgcccaggctgaagtgcagtggtgtgatctcggctcactgaaacctctgcctcccaggttgaagggattctcctgcctcaccctcccgagcagctgggattacaggcgctcgccaccacgcccagctaatttttatatttttagtagagatggggtttcgccacgttggccaggctggtctcgaaccctgacttcaggtgatccacccgcttcagcctcccaaagtgttgggattacaggagtgagccactgtgcccagcctgtttggttttgtttttgttattgtttgtttgtttggagtatgtctttattagcagtgtgagaacaaactaatacatcagaagttctgattttcatatcagcacagagaaaagtgaccttcccagtccagtctatcgtattctcaaattactttctctaacttgtgaaataagatcttcttggtgaactttatcagacatttctgaacagaattaccactctgtggtggcctgggtaaatgtaatatatttataataatttgaaaagattcctccaggacttttacaaagacagatgatattaaactgaacaaatagtgctaggtaagaagtaaattgttcaattttttcacagaagccctgtagattttagcaaaaccccccagacacaatgtcaaatttctcagcaggtttcttggttttagctcttccccttaagcagtagttaacagaatattagatgttagtaaagttatttctttgttattctacctgggttgactaccagagaaaatccctgaacattttacaaattgctcaacagattttcatctaaaactagaaaagattggccagttatggtggctcacgcaggaacattgctttagcccaggagctgaaaaccagcctgggcaatagagtgggacccccatttctaaaaaataatatcttttaaaaaattaactgggcatggcggtgcgtgcctgtagtctcacctacttgggaaactaaggagggaggattgcttaagcccaggatgtcaagattgcggtgagctatgattgagccactgcactccagcctggaggacagagtaagaccctgtctcaaaataaaataaaataaaattagaaaggataggtgtgtttgggagggagactggttaaccagggtgcatgggattatgtagggcttgtctttcatttgagttcttctctgtctttttaaaatgactgattatatatattaggtcccaatggcttcattatcactattattttaattcataggttaaattttataaacatgaaaaataattgacaagcctagaatctcttttctgtctatattagaaattaaattatatttagtatttaagcaatacatgcatacatctcatgtaatccttactgtaattaaggatgaaattatgtaacataggaaaagcagatgtaagttctcattctccttttacacataaggaaattaattcagacttttagtaagttgcccagaatcacgcagctagtaagattcagaactaaaaatataatacctgtcttctaattcaaatgtttcacatccaagtgcccatatactaataatttttaactcttttgttggggttaaatgagataaaattgagtcttattgtatagaatttatcagaaatagcaaaatttcgcccaggcacggtggctcacgcctgtaatcccagaactttgggaggccgaggcaggtggatcatctgaggtcaggagttcgagaccagcctggccaacatggtgaaaacccgtctctgctaaaaatacaaaaattagctgggcatggtggcaggcacctgtaatcccagctacttgggaggctgaggcaggagaatcacttgaacctgggaggcgggggttgcagtgagccaagactgtgtcattgcactccagcctgggcgacagagagagattttgtatcaaaaaaaaaaaaaaaaaaggaaaatctctaaaatgatacctaaaatgataaacaatttaaatttagcataattatcattttttaacttacagattgacatatttctgcaagtgttttcagaggcattggggccacagaagtccaagtcaaggcaatttttggtactaaacagttgacttttctctggtccacatcaaagctgccactgtgcagagaactaacatgtgtacgtgactagtctagggctggaggaacatgcgaggggactgttggaaaggaaaaacttttgctcttcctctaggttcagtaaattagggactgtaaacaataataatgaaagattaataagaggcacacaattttattttattttattttatttacttatttttttgagacagagtttcactcttgttgcccaagctggggtgcaatggcacgatctcggctcaccacaacctccccttcccgggttcaagtgattctcctgtctcagcctaccaagtagctgggattacagacatgcatgaccatgcccggctaattttgtagttttagtagagactgggtttctccatgttggtcagcctagtctcgaactcctgacctcaggtcatccactcacctcggcctcccaaagtactgggattacaggtgtgagccactgtgcccggccccacaattttattaatatttatatgcaaaagagcttgtagaaaatcagtgaaaatcaaagaagtggttagactagggggtttataaacccttcttaaccaaggaaagagggtttgggcatcaatgagtggcgaattgtggagaagtgactagaaaatgtatgagagaaactaatggaaggtatattagttcattctcaagctgctataaggacatgcccaagactgggtaatttataaatgaaaaaggtttgactcacagttctgcagggcgtggaggcctcaggaaacttacaatcatggcagaaggagaagcaaacacatccttcttcacatggcggctgcaaggagaagtgctgagcaaaaaggggaaaagccccttataaaaccatcagatcctgtgagaactcactcactatcgtgagaactcacttactatcatgagaacagcatgagggtaacagcccccatcgttcaattacctccgaccaggtcccttccatgacacatggggattatggggactacaattcaagatgagatttgggtggggacacagccaaaccatatcagaaggtaaggcctattttagtaagttttgtttatgcaaactcatctcagtgttgactccctatctttataacatgggtcacttttttcttcctgatggtgtgggggagagggcacctatctcaaagagaaattttgctctgcttttagatgtacaagggaaagacagagaactgttcctgcatccattgattatcaattgccttcagctcaaaataatccttatgccaaagtagcatattttggggtggcatatttcaacctccttcatctctacccagctggaactgtccagggagttgcatacctcaaaagctgagttggtggctataaagacaagatttgggttagttcctgagaggtaagagacctgcaaagggaaagaacatagatcagaacgagaataaataagcagaaaagagcaaatctcagcacattcccactgatctcactaaaccaggctcctagtactggaaataggtcagtcaacttcaacaattgtatctcatttcaggaagcagcatgcaggtgggagtggggcacccctctgaagtttggcctttatgctatgtgaataatcacacacttaaagagaggcatttctatgaaaacaaaagaaaaacaaagattaacagttggagcagactctaaagccagtttttgagtccagaaggcagttagttggcaagatttctaaatgttggattcaaggctgggtgcggtagctgacatctataatcccaacattttgggaggctcaagtgggagaattgctcgaggccaggagttcaagataaacccgggcaacacagtgtgactccatctctaataaagtcatccaaatgtagttgtatgcacctgtggtaccaactactcaggaggctgaggtggacggattgcttgagcccaggaggtctaggctgcagtgagccatgatcacaccactgccctccagcctgggcgacagagtgagatcctgtcttaaaaataaataaataaataaataaatgttggatgaagtgtctttagatggtggattgaggataacaggggcagtctcagtcacgtgcatttcccggagtttgaaggaacatgttctggtgagcttcctgagtggtccaaactacggtagtgataattcctttgaagttaggttcagttgtccaacttcagcttccagggctccaagaaaagggcaattgtggttctcagtgatgccaagtcacaagggtgagagaagactggaaacattaattacaagatggcaggattcagtttataaaggggggaaatatctcaatgataatgaacattcacaagggtgggttatagttttccattaaaacataaaatttctttctacaatcacccccaatgtgatcaaaaacaatcaaagtatgtctgcttgtgtctggcaactgagtctagtctcattaaacttggccagattatttacataataagtgcagcaagaatagtaatttagcacgtaggcttttttgtgtttgctcttctggaacttttaataaggactctcagaatagacttttaaaagctcttgagagtagtaagccaagccaagaactagccattagactttatctgtaatacctatagattggggtgaatttcccttttcttgaggactctaaaacattctgagtttcccgggcctgccagaaagttaccttccttacccacctgtaaggctaggaacgctataaaccagatacgagtcttacttttccaagggagctttgtaagcgttggtgccatatagtcaaccttagttccttaaaactattgggttatatgtgattccacacacattattttcaaacatgacactgcagtcaaagccttagtaggacagccaatgtttccaattgtgttctgttccaaggagaatagattcttatggaacttaggcaaataactatattgccatgaaaattgaaatactcaataagcatttctgaattttggagagatcaggtaggggcaaaagataaatatttcatttttgtttatgaagacataatctattaaattattgtgaattacaggtagcttttagaaagggtttcctgacatccagaagatagaacattaaataaccagcaaggtttcaatcaaaaaggccataaaaattataattgttttttatcagttcattcagtcccatgtaattaattcttgttttgcttgatcttagattagtggatttatgaatccatcagcttctccattagttctggaaatccttactgtgtccagtgttataatcttgaagttatttaagcaatgtcagcagaagcctgtactccagagtacctgccaaggttttgttcatgaatctctaatatgctctttctttgctgaagatgaggcatgctggcctacagctgactgcgtgagccttcagaaaagcatcggcataaaacaataattatctgtgaatgacaatgacttaaaatggccatacctaaagatctgatgaaagttcattataagtcaattgataaagaaatttggttgtttctctgacatacaggattttaagataataatgtgataccaagacatctcatgaacagcaagggcattgacagatttctaggaattttatatgatttctgaaaaatcaaaatcattatatccatacaaatataacccaggaatggttaaatatcttctctttatttgacagtgcttcccatgcaatttagcatattaaataagctcatctctctttttacaaactgagagaacaaatcctttgagagttttccaggggccctctgggaaattccagagtcaattcaaggtcaagaagacttcatttggaatttgatttagggaagttgtgaaaaacgtgaaaaggtttgaacaattgattaaatgggatcacagatcactataaaacaatacttagttatctatttaaccaaagtgacaataaaagattttcaagataaatatggaagataacataatcataaaaaattttaactctttcaatcttaagaaaacttggttttctgaaataatcaaagacataataagtgcaacataaagcacagaatatttattttctaggtgtatcactcaagaggtaaagaaaacatttcataatctcttaccaagaatagactactcggtatagtggctgaggcctgtaattccagtcctttaggaggctaaggtgggaggattgcttgaggccaggagttcaagaccagcctaggcaatatagtgagaccctgtctctctaagaacaaaaaatagattaataaaccaagaaaacttgctcattttaaaagtagttttgcatcaatacactactgtattagtccattcttgcattgctgtaaagaaatacctgagattgggtaatttacaaagaaaagaggttgactcacagctctgtaggctatacaagaagcatagcagcttctgcttcttgggaggcatcgggaagcctccaatcatggcagaaggtgaaggtggagtaggcgtcttacatggcaggagcaggagcaacagagggtaaggggtcaggtgccacacaattttaaatgaccagatcttacgagaactcggtcactatcatgagtacagtaccaagagggatggtgctaaaacgttcttgagaaatctgcccccatgattacaatcacctcccaccagagcccacctccaacactggggattacatttcaacatgtgatttggtggggacacacatttaacccatatcaactactaagctcattctttaaaaccttataaatacacccattcagtcctagccagcgtggccacacaatgtaagattctctctctcttctgttctctctctctctctttcactgacctttacaactttctatatcaactcacatttttgtcctttattttcgtctttcttatttaaatgacctctaaactactctaggataaaagtcactgtcatttttctttaacaaaaacacatctcactctccttgtactctttgcctgcagagttttgtttcttcatcctattattactagtagttcatttacacatatttattagatttcttaacccttagtaacattaactttcagtgaaaatgaagaaataaacaatcataaactgtcagttacatacatgcattctgtgctacattagcacaggtataaatacattctctcataatttctagaggcatgtttcctaacagtacaacttctcagtgtggcaaaagagcaggtttattaacagatccaaatacctttagtctctgccaaattaagaagtcaaaagtagccgggcgcagtggctcacgcctgtaatcccagcacttcgggaggctgagatgggcggatcatgaggtcaggagatggagaccatcctggctaacacaatgaaaccccatctctactaaaaatacaaaaaaaattagctgggcatggtggcgggcgcctgtagtcccagctactcaggaggctgaggcagaagaatggcgtgaaccagggaggcggagcttgcagtaagccgagatggtgccactgcactccagcctgggctacagagcgagactctgtctcagaaaaaaaaaaaaaaaaaaaaaaaaaaaaggaaataaacttaaatagataaactttagtaattagtattttggtattttattttctttgaaattatctacctatttcatgaatatccgtcatttaacttagtataactttaagatttcaagtaaccaaaaagatgtcggaaactatttttaagtcactgtactataaaacagttattgttgaaataaagtttgtcagagtaatgactcaatctgaataaaatgccatctataagtttaatagccttaaacctcagtagttataatgttagtttgactagtaagtccaagtagaataaaatgtatatttcatgttgacaacttgaagacgtaactctctttaattaaagaaataatattaaactggtagtagcggtgaatccatacgggtatgcagcatccttacatcttgcctccttagaagaaagagttcagctgacggacatacgcagagtgagagaccgaggcaagttttagagcaggaatgaaaggaagtaaagtggaagatggccaagcaggcgacttgagagatcaggtgcaccgtttgaccttctgacttggggttttatacgctggcatgcttctggggtcttgcattccttctcgcctgattctttccttggggtgggctgtccacatgctcagtggcttgccagcacttcaaagggtccgcatgcacagtgtgtttactggacgtgtacgcatgcccacttgaggtattttttcccttagcaaatccagtgttcctagaggaaggtcatccgccattttgccttttagtgccatgcttgagcccacttacccaactcctgcgatcttagccggaagctgctgatcagcagtttcaggctcttcctatctgttgggagcctgcctttccctggtgccagctgcaaccaattattattttagagagacagttaaggactgcctgtccatcacctgatggtcgtctgacattcctggttgtggggaaagggaaccctctcctgccctgctcatgtctgactagctacctgctgtaacaaaactagttttatttaccaaagattatcttatatcagataaacttgaaaacatgttggttatatttaaccattaaataatatatttggttatatttctgagtgttttagcaatacttataagcgtttttttaagccaacttagaatagaactcatttattaatttggtaataccatcatgaagtgaggaaatgtcacataggtacaacgtacatacatatatacacacataaacatataaagatttatttattttaaaatttaatttatttaaagacagaaacagatagagattattttaagattttagccacaggtcaggtataaatatagaaacacaaaactcacaaatttatatgagctggcatttttgtctttttaaaaaaatctgaattgtatttctggcagatggaacaagaggttacctgctcaatgagggttaaggctttttatcaatattgttggtggagacttaaaaaatttttttcttgacataataatttaatgtagacagtagcattagtctcaggttattgttttagtcaacagaaattaaagccaggtgacttttgggctggaaatcaaagttattaatatttccttaggtgtttacatatcaaagagatggccctcaggtccttgagaagacagttttgggtggtagaatattttacagctgaaggaggaagagaaaggatgtaaactttcaagtagtccctttaaaagggagttttcgggcatttttgtctgttacagggttgctgcgtatcattgttgttattatcaattgttattttctgggacaaacagtaaattcttctggtagcactaagctttatcaagcaggcattttaaaagtggggttggggggatgatttttgatgggtgtgaattttaagttcttgtctaaatctaatttatgcttgttaattttgttaagggagctatccagtctaaccatgatacacttgtttccttctttcaacttgatcctcccataggtagcaatacgatgtttatttagggtgagagctctctaaatatccttttaaacataaaagctttttcaaatcccagttccatcatctggtctttgacaatttaggatctccaaaggtatacgtgctccaaaatgtgacacaaaaccagtaagacttttatgactcaaaaccaatcatccattttatggtttaaccggggaccaagagttgtccccagagagggtgcagaagactctgccctcatgatggaaagtcattcccaaaaatagccaaagagaaagcgagctgagaccctcatggtcacaggcagcaaaaatggtgtttgtgaaaatggtatctccagcgttacacaaaagtgaggcacctgcaatcacagacttgtggacctgtgacacttgggaggcaatacggagatgggactttttcagcactaataagacaatgaggaaggacaacaagtgccttgtatgagctgagacactttatttagacaaattccccagattgctgacatagccaggtgggaaattttgctagtgttttttagggtccttgactgacagcgagcacctccagactcaggcccaaccacctgtgcttcccagtgggcaaaaacacagacagaggtgaggcgtggtggctcaagcctataatcccagcactttgggaggctgaggcaggaggatcacttgaggccaggagttggagaccatactgggcaagatagcaagaccctgtctctaaaaaaaatttaaaaattacctggacatggtggtgtacatctgtagtctcagctacatgaaggctgaggcaggatgattgtttgaccctgggagtttgaagttacagtagctatggtcgcaacactgcgctccagcctgggcaagaccttgtctctttaaaaaagaaagaaagaaaaaacaaaacaaaacaaacagagcatgctgttactagatctaagtcaagttctcgggacagaagggaggacttcatcgaatttcttttttattggggacccacaacaacatttgcccaaagggtctgtagtctgctgagaactttaaagtcaccagtctgtgaggctggctcaaacaacaggcttatacacctgtgccaatattctattctatgattttcctccttatgacaaacaacacaaaagacagagacaaagagaaaacaatggctgtctccaggaggaaaaggattaatcacaaaagtcctcaagccaaaaatcacaaaagtcgcaatacccaaagaattatttcttacaaatgttttctcctgccaatctaaatttggagaggaaaagacaaggaaatgctcatactgcactccctcaaccaggctctctgcagaaatcttggggggtatgtggggggatctttttgactgggcatggtggctcacacctgtaatcccagcactttgggaggctgatgcgggaggatcacttgagtccagaagttcgaggctgcaatgagctgtgattgcaccaccgcactctagcctgggcaacagagtgagaccctgcctctaaaaaaaataagataaaaaaagcagtttttcaagggtgtacaatctcctacagcattctatctattctttgattaattaccctcaacccatttagccattaatttattgaacaatgtattagacatccacttcgttccaaagactctactttagggttgaaaaaaacctaggggtgaacctggcatggtttttgccctcaaaattcttaccctatgatgggagagagggaagatatgttcatgattaagctctaagtcagaatggtgaaaaaaatcctttatagaagtacaaagatggagcatgcctcttactaaatagttgtaagagcgagcaagagttactaaagcacttcaggttaaggggaggcagagggtaaggcaggttagtgatagggtacttgtaaaatctccaaagcatgaaaaattttctaatgttttgaagtagcagaatataaagtttgtaggagacaatgtccaaagaagagactgaaatggtagtttgaagccagtctgtgaatccattgaatggaacacttcacagtttagttgcctcttcttgattacagagacttacagaggcatttcaactggaaagtgtttgatctgctttgttcatttgaggaaacaactttgctggctgtgaaaaatgataaacagcatgagggagaatttgctggcaaaaaacaaaacaacaacaaaaaaactaagtttataatgcaacagtcccattaaagagtaacatgaggtgcccttatatacttttagtggcaatgtataacatttggaagtaacttggtagtacttattaatcctttgcaaatctttgcccaaatgagtgacagggtctcactctgttgcccaggctggagtgcagtggcatgaccttggcttactgcaacctccacctcccaggttcaagcaattctcatgcctcagcctcccaagtagctgggattacaggcatgtaattacatgcctggctaatttttgtatttttagtagagatggggtttcaccatgttggccaggcttgtctcaaactcctgacctcaagtgatccacccaccttggtctcccaaagtgttgggattacaggcatgagccaccgtacccagactacaaaaatgtatttatggggatgttcaatgcagtagcagctcatatgtccattcatagaagatgggttaaactctgacgtagctaaaccagctaacacttttcaaccattaacaaagaatggtagagtggaatgtggtggcacatgcctatagtcctaactactcaggaagctgaggtaggaggactccttaagcccaggagtttgaggtcaacctgggcaatatacaatatagtgaggccctgtagagatctataatatgttctgctgtaaacataagtccacaatataagggccatttttttttttttgagacagagtttcacactgtcgcccgggctggagtgtagtggtgcgatcgctgctcactgcaacctccacctcccaggttcaagcaattctcctgcctcagcctcccgagtagctgggattacaggtacctgccaccatacccagctagtttttttttttttgtatttttagtagagacagggtttcactatgttggccaggctggtcttgaatgcctgacctcgtgatccacctgcctcagcctcccaaagttctgggattacaggcgtgagccaccgcgcctggcctaagggctattttttaagttgcaaaacaaaaacaaagttttaacagttgtcattctgatatgtagaattattaggaaacctacactatttattttttatacttgtatatactttgtggttttgttgttgttttggttttttgtttgtttgtttgtgtgagacagagtctcactccgtcactcaggctggagtgcagtggggcaatcttgggtcactgcaacctctacctcccaggttcaagcaattctcaggcctcagcttcctgagtagctggactataggcacacaccaccatgcccaaataatttttatattcttagtagagatggagtctcaccatgttggcaacgctagtctcgaactcctgacctcaaacgatttacccacttcagcctcccaaagtgctgggatcacaggtatgagccaccgtgcctggcctatacttgtgtatactttgaattgtttcttttttcttttcctattttattttattttattttatattttattttattttattttttgcgacagggtctggctctgtcacccaggctggagtacagtggtgcaatcatgactcactgcagcctcaagctcctgtgctcaggtgatcagcctcctaggtagctgggactacaggtgaccaccatcacacccagctaatttttgtattttttcatagagatgaggtttcaccatgttgcccaggctggtctcaaattcccaggctcaaatgaacctcccacctgggcctcccaaagtgctgggattacaggtgtgagtcaccacatccggcctgaattgtttctattattcacatataactttgtaatcttaaaaaaaatacttaagactttaaaacaaagatgattagagcctggattaagctagtgtcggcagcctgaggagggaaggttttggatgccattgccaaagtagattgaagaggaattggaatttgagggatgcaggtgattaaaggagagggggaagagtcaaaggtgacactcacatttctagcttggtaaattggttgtttgtttattccattaatagaaatagagaaaagagacagcagaggagggcttcattgaggaggatgactttgttagtttcattttggatttaagtctgagggtcctgaaaaggcagctatatgtttggcttgaacctctccactttccaccttctcagtaattcattaatattttggatgtcctagcctgttgatgtgtgtgtactggaggtggtggtggtgggagctaatatgtttagaagttaacatttcatctgtctttatccttttactctcctttcattcagaccctacaattattgctacagggaagaaatgtggccttgcctgtgaaaatctagtttttggaattttttttgcttgttttccccctaaaatttagctccaaaagagagaagattcttaactagtggaaaaaatgtcttggtcagaaacaggagaaagaacatagctatcctagacaaaaataataataataataataataataataatcataaaagcaagggagggagggagaaagggaaagaaagagagacagaaagaaaaaagaaagaaaagacaggaaaggaaagaaaggagggctaggcatattgcctcgtgtctataatcccagcactttgagaggctgaggcagaaggactgcttgagcacaggaggtcaaggctgcagtgagccatgtttgtgctgctgcactctagcataggtaacatagggagaccctgtttcaaaaaaataaaaaataaaaaaaggaggaaaggaagaaaattccagtagaataaagaaaaaaggaaaaagaacaatatttacaagtacctgcagagagaaggtgagaagatgaagacctgttttctacttttttgggcagcactgctaaagaaataaaaaagtacccagaagtcgcaggactctaataaaatggaacatcacctctattcctgcctgttctttggaggagtagaaggtgaggaaatggggaagtgcaggatgagtgattctggagaagacatggctgtgctcatgttgggctgatgatgtcactgataactaaaacaaagggctcagccaggcacccagaagcctcagggccaccgcaccctaaggaccatgcaggctgagacaggactcttttcagtaatccggaagatggctccaccctctctagtccaggccataccctgggccatacccttagcagtgctacccaaaaaagtaaaaaacaggtcttcgtcttctcaacttctctctccaggttcttataaacattgttctttttccttttttctgtattctgttggaatcttcctttctttctttctttccttttttttttttttttctgaagcagggtctccctatttttttccatgccataccctgaaaaaaatctctggggagaggatcccaaagagacaaaggctaattttctcaccatgcttatagattaggggctttgagaaaatgagggtatgtttttaaagtattttaatagtggactgatctattttacctcctggaccagatgaaatgggaactgttccaattcatggagcaaccagacatacatgttcaaacaattatgaaaaacatacaacagatatttatcaacaaatacatcagtaaacaaacttacatgaccctgcttggccatcactgtttcttttcaacacacacacacacatttacaaatacatatatatgtgtgtgtgtgtgtctgtctgtcgatatatatgtgtatatatatatatatatatatatatatatataaataaaataaataggtaagagctgcttatagccctgaatccccacagaaaaccccgtctgtctttagtttcatgaaagcattgtactttttctcattatttttcagaccatcacagacacttctgatcagtgttccacttaagcttagccccaaatacacagaggaattttatactgaaagttaaagaagcgacagtagttagattatctcatgcctcctagattggctggctttgagcactttttcaaagtgtgtaccaactagggtttgtccaccaagttgcaatggcttgtatttgagtcagccatacgtgctcatggataaaaacaataagaactctttattaatataaatatactctgtgaaggcaaagatgtgctttaaaggaaatttctgagcatgtgagaagtagatgagttacatgaggttaggagcatgcagctgtgaccctaaatggggagaatacagccccagggagctgtgatgcacggccactgggaagctaatgaaatgggcagagccaggaccagtggggtagaattaaggcagaagcttccctcttgtgctggacattgtgctggtctctttcctgcccagcacatgccaggtaggaggctataatgtgatcatgggtcattccatgccacaggaatggattggcctgagctggccttcttcataatccaggaataaggagaagaaagaggtaggacagaagatggtcctttatgggggatgagggggatggaggggggaagcttctagaggaattggaattttcacagaaagacatttctgcttagatactaatacagacgtacatatttggacaatatacatgtagaataaaaattatttgaattacttcaacaattatgcctacttttcaaaaggctttgacatcagctatataatttagccatttggcaatattaatcataacttactaaactaaatttgacattgggataacagaatggtaaaatgcaaactgaaatcatagctttatgatcacatgaatttccttcaacagctgttcactgttattactacttatacctttgttagcattccaagaggatctgataatcatagctagcattgattgagcaattattatataccagacattcttctaagtgccattatctcatttaccctacataacaaccttatatggtaagtatcttttcctagtgccttttattgatgacatgaatgaggcacagaaaaaataggtaacttgttcaagtccacacagctagttagtggaagagcaggaattgaatccaggcagggtggtttcaatacttcagtcttagacataataccatattgccttcctggtacaatggatgctttacgtaggaggtgttatagggagaaattcccacattttcctttttatacttgtatattgtttgaatttgtttataataaggatacatctcttttgtaacttgaaaaccacaaagaagaaatagaacaataaccccattcctttaaaaatagcattgcagtagctatttcaggtagtgagatatcaaactggttttaacttttttgtttatttgttttagttttaagaatatccaaacaaagacggatacatgtgaaaacttgggacagtaaaattgtgacctttctataaagacaaagaggtaggaatcaagccaaagtgagattaggataatgtcaggtcttagtactctattctgcataatagtttattttaggtaattctctatattggttggcttgctgaagctggtgtgtgtgtgtgtgtgtgtgtatgcgtgtgtgcgtgtgtgtgtgtgtgtgtgtataaaaaatctttttagtcgttcttttttatttgtgcttctcaacatgcttaagcaagtgatatctttccatataaggggcaaaagaatttggggctgtgaggcaggctgacaaagaggaaatatatcctgtctaagcaagcaagaaaaagggaaaggagtgaaaattcttgcaacatttagctcttccgaaaaaaaaaaaaaagtggtcatgatttctcctatagtagttgatttgtcactttacacaaaaggcctagaaacatatccattatagatatgcctccttggggctcagcctctatctgtcaagtaggggtaatgggtcaatggaattgattatgtgatctataaactttgttccagctttaccatattgtgaattttgaggtttggtcaatgaatatgcaaatccaaccagaagtatcattggatacaaaagtatccgtatcatttttgagaataaaatttccaacagcatttttatatatatcagtgaagatctgtgtcacaaaacaaaactttatgaaataggaaataatctggctgatctttgacagtacaaaatttgacattccaagtcaaattttatgtttaggtagaatagggaagtattggttttgcagttttaccatatcaacacatataatatttctgcatagaaaaacggaccatctaaatgggaaaggggagagccaactagtgggtaaaatgctgtaacagtattttaatgctcaaggcccaattatgacttgaagatgttgttgtactgattagcaatactaactgaaaatttttctaacaggttcataacctaagtattttccagctatatactgttggtctcagggattggcaaagctgaatcagaacacttctttgccaagacttgtctgcaaattcttaacctttttttgtttgccaagaacaaagaaaaattgttgtaaacttagctgctgctgtaacatatgagcagtcttttccgaaaatgcaaattagacaaacaagaatcattacatcatttgcagaaatgcagttacatttggtttctgctattgtgtgtgtatatatatatatgtatatatattactttcatatcttacttgataccttttgtagtgctttaccattttcaaagcacttgcatatgtgtcgtattatttgatcttttctgagatccaaagtttttaacatgcttcatgcttgaaaactttgatacttcaatttatatgatgcatgtaacatacaacaaatgttttgattatggttgtatggaaaattcttattatatccccaaatataggttacacattttggcaaagtaagcagttattgatttttattgccacatgaactggattttcaaatattaccaaatgcatgtgtttttgtttttgtttttaatacaaaaacatcatctaatggatagtgatttatgccagtatgtaggaaataagcaagtattttgggtcaggtggattactgctgaagctttgattaggcttgaaaatttgatacactggaaagctaactgttaccctatagattactaacaaactcattgcttcaaataaaactgttattgattgttcagattaaaaaaataatgtcgacttttgttttagattcagggggtacatgtgtaggtttgttacacaaatatattgcataatgctgaggtttggggtatgaatggtcccatcacccaggtaatgcaagcaacatgattttattcttttttatgactgtgtagtattccatggtgtatacatatcacattttctttatccaatccactgtttatgggcacataggttgagtccatgtctgctattgtgaatagtgctgcaatgaacacgtaagtgtgtgtgtctttttggtagaatgatttattttcctttggatatatacttagtaatggaattgctgtgttgaatagtagttttaagttctttgagaaatttccaaactgcttttcacagtggctgaactaatttagattcccctcaacagtgtataagcattcccttttctccacagcctcgccagcatctattattttttgacttcttttctgactggtgtgaggtggtatctctttgtggttttgaattgcatttctttgatgattagtgatgttgagaatttttttcatacgtttggtagctgcttgtatgtcttcttttgagaagaagtgtctgttcatgtcctttgcccagtttttttgttttgttttgttttgagacagggtctcgctctgtttcccagaccagagtgcagtggtgtgatcagctcactgcagcctcaaattcctggctgaagcaatcctttcacctcagcccccaaatagctggaactacatatgtgtgccaacacacccagctcattaaaaaaaattgtagaaacaaggacacagtatgttgcctgggctggtctcaaacttctgagctcaatgatcctcccaccttagcctccagaagtgttgggattacaggcataagccactatgctcaggcctttgctcactttttaatggggttatttgttttttgtttattgatttaagttctttatagaatcttgatattagacctttgcccactgcttagtttgcaaatattttctcccattctgtaggttgtctgtgtactctgtcaattgtttcttttcctgtgcagaagctcttcagtgtaattaggtcccacttgtcaattttgtttttgttgcaattgcttttgaggacttagccataaattatttgccaaggccaatgtacagaatggtatttcctgggttttcttctaggattttaaaagactgggatcatatgtttaaatatttaattcatcttaatttttgtatatggtgaaaggcagcagtccaatttttcttctgcatatggctagctaattatcccaataccatttattgaataaggagtcatttccccattgcttatttttgtcgactttgtcaaagatccgatggctgtaggtgtgcagctttatttctgggttctttattctgttccattggtctatgtgtctgtttttgtatcattaccatgctgtttttgtatcattaccatgctgtttttgttactgtagccttatagtatagtttgaagttcagtgatatgatgcctctggctttgttctttttgcttaggattgctttagttattcaggctcccttttggatccatatgaattttagaatagcttttctaattctgtgaaaaatgatgttggtagtttggtaagaacagcattgagtctatagattgctttgggaaatacggccattttaatgatattaattcttccaatccatgaacatggaatgtttttccatttgcttgtgtcatctgtttgtttctttcagcaatgttttatagttctctttgtaggtatcttccatctccttgcttagatttattcctaggaattttaacttttgtgtggctattataaatggcattgcattcttgatttggctctcagcttgctgactgttcagattattgttttataaaagccacaaaaatgttccattagctaaaagtcacgtttcttagttaatagaagtcatagtacataagaaggtaagagtgtcaaattattactagttgtgaatgaattattactagttgtgaaagaatagcaattcatggttttgtttggtcagcaactactgcaccctagtgatgatgaattctctagcagattggaaagatacttagggagggaaaaaagatgactttattaaggatctctggaaataggaaaatatttaagaaattctataagtaaaaatgagtaattttatgtcagaataaaataaaatttggctgaatttatagttctccatctgcctgcttgcacctatttggggcttattttacctttgtggttaccctgagaagcatggtatggctggagcctaagtgagttctttgttttccaaccacattgtcctcttttctttttataaaatacatcaaattccttgcaggtttgtctgtctggagtacttacccaccttctttacttagtaaagtactacttcttttttaggtgtccatttaagttcaaatccttgaagaacttttattttgtaataaagattagattcatatctcctgttaaacactcttatagtattcaggatataccttctaagtggtacatgtggggcggccagcagaagaagattttgtattaggtatcacatttgagaggaaggaggccccgtggaaaaagcttcatcaaaagaaaacaaaagaggtgtttatatgtttctcaaaaggcatgtatctatgtgttggtgaaaactgccttaataagtattacatgtctaatgtgtgtatactaacatgcagctctacgaaatatacaaaaaagttaagcatatagcctatgcttttgaaagcttgagatatatttggggaagtaactatgaagggatgtcccatgtagcctcatatggagcataaaataatgaaatgctatttattatatgtcatgtatgggactggcctgtatggggtcatttgagtgctaagacaagatttctttaatttgcagtactttcccacaatattcatatgagttaatacattatacttaggaaattgcccctaagataattaaattaaaaatatattaccatattaacatgtaaacacaaattggtttaaatgttctctagcaaagatcaaatctaggacagagaaacaggagaagaaaacaggaaaatggggctcagagcaggggaatgctgtgttgtttaaaagccctggatgtcaagatctaaggaaaagataaaaaaaatagaaccaccaccaaatataaatatttatttccatatctcacaattttttcctaggccattgctggtgacagactttccagtccttttcagaacttactcatcacatccttttcatgcttgttattttgatcctgaacatccttgcaattcaaagagcatacagaggcagagtgaaattagcataatgtcacctattgctatgatgctcgttacctctacctccagaacatgccaaggaggcttccaggagccccagaaacacagaacagcaaatcttcaaaagcccagtgcccagagcagatagagaagaaaattctattttgaaatccataaagaatctcataattccttgcaatatctagtcccaattgtgtgggtgacaaactgacctatggcagaattaggaatgtgaataggaatgaggcttggagttccccattcctgctgccctaactcccactggaatgtaatttgtacaaagagtgacgacatgtgaagatgtaaaaaagaggactagagatgtcctcctgagctgcacaaggaagaaagctttttatgaccatccaattctgcaaaggacctagtttcccagtgcttattaccataaggatgcagaaagaaaaaagttcacagacataagatttcatgtgaaaaccaagaaaaaaaggttactgtattttttaaaggaatagcatttgatttggtgtaatggcaggataaagaaatgagaaataacagtggggaaaaaagttgactacaaagatgtgaataagatcagatggcatagtaattttattcgtaattaaaaatctggttcagttaatggagagatttaatttcaggagcattaactagtagactactggatacaatgtacatgtttaaataaatcataaataagtttctcctaagagctactttaatgttgtagcattctaactaatgagtagtatgacaaaattacgttgttattataatagcaatgtatcagtttttctgttgatgaaatttcttagggttagaatttttttttaccagatatgaaatagacttacacttaaatactgttgaaagttgccatataatgtggctattatcttggagttaattaaagttaatttagttttgagcattattaagctctttaagaaaactggaagacatcaaattcttataaaggaaagcaggacctatttgttaaaacaaaaagaaatagctctgtattcaagagtagttttctcaatggatactttgcccgtaaacattaaaactcactaacacttaaaataaatagatttgaatggatggctcttaccacaagttaaaggttgttatttcattaagctaaatgtagtacgtataactgatttttttttttgagggaggaggcattaccttggagaaggaaatggcttcagataacatctatgaaaataataataataataataatgagattatacgcaagatttgaaacattttcagagttggatagaaatttacacaaaccagatttcccctgggagatcctaagataaactaacaataatgtcacacacatatcctgttattttatttactaaattctaaattaaatttctgctctggtgctatgaaggtcacccagcgtactcttttagataatacaggagattccaggattgaaccaaaaccaagctaagcagaatattttccttccgagagatttgaaatttgtgataaacacgtttgattttttgtgtgacattatttggtaaaagtaactttttcagaagctcccccaaatctctatacccttctttgtgccaccgtgttttcttgtgtattggaggtggataagcaaactgcaattgggatagattttcacctaaatttctcacattttcataagtgttctgttcctcttatttactgcttgcaatccacatgtgtatactgcacacacactcacacacatatacacacacataccctcatattctaaagaataaaaacacaggcactgtaattgcatatgtgtatacttagggggttaaagcctggcttcaccactcagtgctggtgtgaacttggagagcttacttagctcaggtccttttgttttcttctgttgtttgtttttgagacagggtctcactctgttgcccaggctagagtgcagtggctcagatttcagctcactgcagcctccaaattccgggcttaagtaatactcccacttctgcctgtagctggtaccacaggcacgtgccaccttgtccagctactttttttttttttttggtagaaacagggtcttgccatgttgcccaggctggtctcgaactcctgggctcaagggatccacccgcctcggcttctcaaagagctgggattacaggcatgagccactgcatccagcctagcccaggttctttacctgtacaatggggataagagtactgatatcacagggtggttgtgaaattaaaatgagatatgtagagatatgtaaagctcttactaaagtgccagcaatataggaaagaacaacaaatgacatttactctttttatgttgtctaaagtcatatgagtatatagtgaagttttcagcataggctctgtgtgagaatacagtagtccccccttctttacagttttgcttttggcagtttcagttatctgcaatcaactgcagtctgaaaatattagataaaaaatcccagaaataaacaatttctaagttttaacttgtgcactattctgagtagagtgaaatctcgcccatcctgttctgtccctctggggacatgaatcctctctttgtccaggggatctatgctgtctacactccccaccctttagtcacttagtaaccatcttgatgatcagattaactgtcacaatgtagcagtgcctgtgtttaagcaacccttcatgtaatcatagccccaaagtacaagagtagtgacatcaacatgttattattattattgttcttttttattattaagtattgttgctaatctcttactgtgactaatttataaactaaacttgatcataggtatgcacgtataggtaaaaaatagtatatatagggtttggtactatccatggtttctggcatccactggggatcttggaacatattccttgtggataacggggaccactgtagaggcaaatggatatagaatatcctttaggtttatttttttgtctgtctttccctaaagcaataaatataaagaaaatctaaatagttggttttgacaacacataggtgtattatattctgcctttttagtgctcagtattccaatatttcattttgtagatgtgaaaattaaggtaatcaagggtggaaatgcttattggagatcatggaactggctcgtgatgcaacagtcatggagtgctggtttaaccgagttgaatacaacacgaatgcccccatgaaaagcaatgaatacagaagtgctcaaaagagtttacctaagaaaataaataggaagaataaaactcaaagacagagaaggtatattaatattcattatcactgaagagaagtaaacttaattttttaatattataagttaatgacctcaagcaaagtcagatattgaaaggtgatcgtttcaaagattgaaactgagtgaaaatatttcaggaaaagagagttttagctattcttaaagaaagagaaaaaagcagattcaaggatagctttttgaagaagatacagcttgaaatggcttcttttactccctcagttaaaagtggtaatggatgtgcctaactaaaattcccacaggaaaaacttctttagttcacctctctcttcctgctttttttagttgatttcctatgtaaatatgagagctcttaataaaaatatgacagaaagttggaaagagttttcctgaaataaataccagatgagtatagtggttacttgaattatgtgcagaaaagaagatgatactctacaagctcggcttttcggcgacaaatctgaagtccatctccattgtgagtatttcttgtgtggcttggacttcctccattccagagaaagaatcagtcctttgggaatccatgaagtgtgtcctactgtgccaggcctcagccactaacacaggtccctagagagccacgctgtcttgctccatgacctccaatgagaaccccttcttactgccctttcattgattaaaacgagacatttgctgggacctcattgtgggctaagcacattgcagtcagtttccacataatgttgctcattggatcattattttaatttttctctctttacctcccccacagctgtctttccttatctgcaatgttgcatgcacaatatttactttcagcaaatgatgtaaatcacccttgaatgaaaagactgaaggtgcctcacctttcttcttcctgtcctattactgtgttctcatggccttggattttctctggataaccacgtatcctagttcatgcttttgtgtcataaggaaaagttggcactcccttttgaaaagctaaacttcccttcctgctattcatcctgacatttctgccctttattaggaacttgattcaacaattttctcttctcttatatcttcaatttctccctttcttgtttctttcctttaggcttaaaaatgtctttaacatccttaggtctttcctattgttaaaaacaagcaaactcagaatccttttctcaaacttaatactttgttgagttggcacccaatttgcctttttttttttttttgagacagggtctggctttgtcacctaggctggactgcagtggtgccatcatagctcactgcagcctcaaactcctgggctcaggtgatcctcccacctagcctgagtagctaggactataggtgcccaccaccacatctggctaatttttgaatttttcatagatatggagtttcaatatgttgtccaggctggtcttgatctcctgtgctaaaacgatcctccaccctcagcctcccaaagaagtgctaggattacaggcatgagtccacgcccagcccttaatttgtctatttttattgttaagtttctcaaagaaatgctcaatgcctgggtcaaggacctctacagatcttgagtctccttaggacatccctttccaactactcatctatttgatgccagattttctacatgtacttcaaccaaaacaacatattgcaacagattgaatgcagaagcagatatgagaatctgctgccttctatgaagcaagacattaaagagatttgcaaaaatgtaaaccagtgctctcttcttttcaaaattatttttattagggaaaatatatttttcataaaaactaggttatttatattactatttaatggagttagcgttgctatttttaaaagagtttatttaaaaagtcttaacttctttagtggtaatttctagtacggtaaacactggtagatttaacccacagaatcagaagctctttgggggtcctcagtaattttaatagtgaaaaggagttttaaaataaaagtagttgacactttatgaggctgaggcaggtggattgcttgaggtcaggagttcaagaccagcctgaccaacatggtgaaaccccgcctctactaaaaacacaaaaattagttgggcatggtggcacgtgcctgtaatcccagctacttgagaggctgaggcaggagaatcacttgaacctaggaggcagaagtgagcgagatcatgccactgcactccagcctgggagacagagtgaggctctgtctctgaataactaactaactaactaactaaataaataaataaaaataggagttgcaaacagtaggtctatatccgtgattgcttttcctcaccactgttgcctcctttttttaaatctctgaccaaagaactggctccacttggtgtcctgtatcagatttcttgggccggccatggtggctcattcctgtaattccagcactttgagaggctgaggcaggaggattgtttgagctcaggagttcaagaccagcccgggcaacatggcgaaactctgtttctataaaaaacacaaaaattagctcagtgtggtggcatgtgcctgtagtcccagatacttgagaggctgaggtgggaggattgcttgagcctagagggtggaggttgcagtatgccagaccttctagatacaagcaagcctcttaccttagcttcctgagtggctgtgatttccctagtcttttatcctccctagttgctaagcaatgtttaacagtgcctacctctcatttcttcttgatattctttccttctacggcaacaaattcccctgatttcttcccaaccttcctgactacccatctttttctctcttggttcctttttcctgggagctgtattttcctcttagctgactcagtatgcttttccttaaagattttttttttctattgcccttccaaaattttttctagatccaaagcctttctcacagtgtcaagaaaaaaacattccagttgccagatgaacagcctgtttcagtatcatgggtctaaaaccagacaccggtttttcctccagcaattcttctggttaacttgatgcctctgtctatcatggaaaccgaatttcctaagtcatgcggatttaaaatgctagaaaatttcttactcctgtcaccactacatctaatgaatcagatgttctgtttgttcttgtgtcatcccagtccactccctgacaaagcatatctgcaagcttatcatcataaacctaggctatttcaatgctcacgtattaaccgctcatcacatgaatagaatttcatttgcctgatttaccctacacagcccttcaaatttatcaacgaaatcactggttttcaacttttatttttaagtaggaaaagcttttccgttaagtttttgcaaacaaatataatgcaatccaatatttgccctccagagctatgccgatttaccgctgaaaccttgagcaaagaaatactcaaagcttcttctaggttgtgtatgtatcacaacagaggaaggaaattatgagatgggcacttgggagactgttttcttggttgccctctccttgtgaaaggtagggctacaagcccccatttgagccaaagctaaggagtccggtgcccatgaaaaagacgcaagcaatgctgtcctccttgatggaggctgcagaggccagaaccacacctgctcagcctggccctgaggctgcccctgtggcactgctgaaagtcagtcttttgtcacaaggaaggcagtttttctagacaagattattctcatcttaagcatgaggtaggggtgtgtgtgtgtgtgtgtgtgtgtgtgtgtgtgtgtgtagtgtctaagtctacttgcctgctttctgggaactggtaagagataggaagatagaagtcatcatcattccaaatgtaggctttcacttaatttctctattttcagtctgagaccacacatttacacgtctctcagcctgcatccccaagctcaaaatatttctgctttaatctcttcagagactaaacctcctgtcccccactacatggagaaggcttggttacctgttattcaaggtgttgcctggatctgtgtatatactttaattcattccctctgttttcagcaccaacacccgccccctttcctcctagcttccttggtacttggtgcctccaatttttgaggctttctataattacttagcacaaatcaactttcttgttgattttcttctttataggagcatagatttcagcatttgtgactttgacaagtcagttgttacaaattcatcagctgcccatctgataaaattttaatgtcttttctactctatctcttctagcttttcttttcttgtgtgtcgatacccattttatttctttacttaccctcattttagtggcatttcaaaaggcgtactagttacctattgctatataacaaattaccataaacttagttgcttaaaacaatgcacatttattctcttagagtttctgtgggccaaggtactgggtgtagctcagcttggccccctactttagagtctctcacaaggctgcagtgaggtgctggccaagactgggatctcatgggaaggctcaaaaggaaaagcatctgcttgtatgctcctggagttacaggcaggttttagttcctgatgagctgatgaactgacagtcttgttctttagtgactctgggccagaggtcaccctcatcccttgccacatggctctctctctatagcagtttgtttaatcaaagctagcaatggtgagaatctgccaacaaaatagaagtcactattttgtgtgacataatcacagaaatgacatctcatcatgtttgccacattctattggctaaaagcaagtcaccaggcccgcccatactcaaagtgaggagattatacaaggcgtaaataccaagaggcagattagaggctattttagtctgttgatataggaggccaaggtgataaacacatgggtccaagtctctctctaaaactggagtcccctctctctcacttccatcaagcttacagtccacttctcctgtcaaggtcaagtagtgacctccatcttgcacaatccagtgaactatcccaagtgatcatcatactcaaacaaacaaccagtagcaactgacatattctcttcctgaggcattttatttctttggatttggggatccctcacctccttgtcttttcccttcatctcttgtctctgactcacaggctcctttgttcattctcatttttcttccttttggagggctaaatgctagaggtctacagggctccatttgtagcccttcactcttctgtaattgtacctaagaaatctagtctcatgacttcatagtccatgtatatattgatgactcttacatttatatctccagctccaacctttcccctatgccccagatagtacccaattggcatctgtacttggactcaaagacattgcaaacttaatttctcaaagaattaaaaatagaactaccattcgatccagcaatcccactacttggcatctactcaaaggaaaagaaatcattatatcaaaaagatacccccacttatatgtttattgcagcactactcacaaagggcaaaaacatggaatcaacctaagtgtccatcaatggattggataaagaaaacgtaatatatatacatacacatacaacacacacagacacacaccgtggaatactactaagccataaaaaataaaatcatgtcttttgcagcaacatggatggaactggaggccattatcttaagtgagataacccagaaacagaaagtcaaatattacatgttctctacttataagtgggagctaaatatgtgtaccatggatatagaaattggaataatagacattggagactcataaagttgggagggtgggaagggttcaagggatgagaaattacttaatgggtcaatatacactaaaagctcagatttcatcgctattcagtatatcagtataacaacaaaactgcacttgtaccttctaaatctatacaaataaaagctaaaaaatgaaaacaaattagacatctcaaatgacaacttaatgcagaactcttgatttcctcatccttccctgacctttacctaaaaacacactctgcccaaactgatgcccatttcaataaatgtcactaccttccacccagttgcttaggtggaaatccaggcattttctttgttcctcttctttttttcacaccccacatacacttctcactcagcatatcctgacagcgccaccttcagaatatgtccattatccaaccgcttctccccagttctcctgcaatcacccaggcgtggtcatggttgtctcttgcctccccttgactggtacatgtgccgttcccctttgcatcaagcttacatctgctccaggatgtttatatttgcagttctctccacctgtaattcttatccttctgatttgcatgtaactcactcctttttatcatccaggtctctccttaaataccacctctttggaaagccttccttgatcactctgtgtaaaatagccaagcctccgttattcactatcttcttttgctcttttatttttcatatatgactacgtgaaagtactgtctgttgttatatgtctagttacttgttatgtgagtataagcttaatcaaggtgatgctttattgcacttagcgctgtttccctgcaatccagtacaaagcccagtatgcaagttataggcatgtggtaagtgttggatatgtgcaccagttgttggacaggattgaacttgcgaggtcagctttctcaggtgacctcaaaggcaagcatctagtttattgagtagtacaacaataggtatgttgcatgtacatatatgtataacagaagtttatttttaagcctgaattagtgatagcaactctgttcatgagtgattatgtggttctttttcatctttactctttctcagagaaattcttctcttcttcccacattgtttgactgcttagagtagataatagaggagtggtaagatgtctgagtatataatgtaagggggtttggttcttgtcatatatagaatacatataggtcctattataaacaacatatggttcttctcatatatagaatacatacaggtcctattaaaaacaacatattgtagctttaattcaacacacgactggttcttgtataaagtttcactgagatctttattgtggagaattgcatgactattccagtcctggactcaatttgaataaaaacataggaaccaaattcctccactaaataactgattgatacttaaatttgacaacgatagctttatagaatagtccagaacatatacagtcgtacctcacttaacaatgtggctacgttctgagaaatgtgtcattaggcaattcccgtcattgtgtgaacatcatagggtatatttacacaaacctagatggtatagttcactacacacctaggctatgtggtacagcctattgctccttgactgcaaatccatacagcctgctactatactgaacactgtaggcaattgtaacacaaaggtatttatgcatctaaacatatctaaacatagaaaaggtacagaaaaatgcagtatagaaaataaaatatggtacacctatgtagagcacttctcacgaatggagcttgcaggactggaagttgctctgggtgtcagtgagtgagtggtaagtgaccgtgaaggcccaggacattactgtatacggctatagactttataaacattcttcacataggctgcactaaatatgtattaacaatttttctttcttccaaaattaacctaattactatatcttttcactttataaacttgtattttttaaaccttttgacttttgttatacttactttaaaacacagacacattgtacagctgtgcaaaaatattctttcttcatattcttattctataagctttttctgttttaaagttattattaattattattattttactttttaaacatttttgttaaaagcacacattaaacacacacacacattatcctaggcctacacaggatcaggataatcaatatcactgtcctccacctccacatcatgtcccattggaaaaagtccagggacagtaacacacacggagctgtcactttctgtgataacaatactttcttctggatacctcctgaaggaactgcctgaggctgttttacagttaactttttttcagataagtagaaggagtgcacttaaaagaacaataaaaaggatagtaaatacatagaccagtaacatagtcatttagtgtcattatcaagtattatgtactgtgcataattgcacggactagccctttataccactggcaggacagtaggtttgtttacaccagcaacaccacaaacacgagtaatgtgttgtgctacaatgtcactaggtgataggaattttttagctccattataatccttttttttttcttttttttgaggcggagtctcactctgtcgcccaggctggagtgcagtggtgctatctcggctcactgcaaggtccgcctcccgggttcatgccattctcctgcctcagcctcccgagtagctgggactacaggtgcccgccaccacgcccggctaattttttgtattatttgtagagacggggtttcaccgtgttagccaggatggtctcgatctcctgaccttgtgatccgcccgcctcggcctcccaaagtgctgggattacaggcgtgagccaccgcgcccagccagctccattataatcttatgggaccactgtcatatatgtggtccacggtttagagtatggaaatgactctatttccatacagtacttccaataataaattaagttgtttgatttctagattgaaaatggctttgataatcttgtaattggatttatatgcctttgagtctctcaagtagaactgatttacctttccattcctttctctttcctctctggtcacatccctattccacatttgttttttttgtaaccagatacacaaataatactttgtattaagtggttatagtgaaagctgggcattctgttctagtgaataatgattcttatattccaaggacaaactacctattaataataattgggtattcggggcttaaaagttgtatttgaaagatgcagccaggtgtggtggctcacgcctgtaatcctagcactttgtaaggctgaggcaggcagataatctgaggtcaggagttcaagaccagcctgaccaacatggtgacacctcatctctattaaaaaagaaaatacaaaaattagccagacatggtgggaagcacctgtaattccagctacttgggaggctaaggcaggagaattgcttgaacctgggaggcagaggttgcagtgagcagagactataccactgcactccagcatgggtggcagaatgagactccatcagaaagaaagaaaggaaagaaagaaagagagacagagagagaaggagagaaggagagaaaagagagaaaagaaagaaagagatgttatccatgatttagtggaaatgagaaaacctagaaaataccatgcaattctaatgaaaattctagaaaactagaaaaaaggaaagagaaggaaattgagaagaccctgtaatctgttgaaatgctgagttttcctaattaaggaaagtaaaattctagtcacttaaaatgcctccaagaaagtcactgtttttgtccatttatatctttctgctttctttttcattttttccctaaaaattaattaaatattaattacttttagaggaaagattactctgataaaatggtcaagaaaagcaaagtttcttactttctgtgccaaagattttcagccaaagtaataaaagaaaaatcttaaaaagggaaactatgcaattcgaatggaagatccattttaaaaagttattgtggcagtataaaatgatactgtgtgctcaaatacctaaaaacttttgcaacttacgaaatggtatttttagtattacttagggtgttgtatgggtgtcttatgtaacttgttaaggtaaagaattttgctattctcaacttcagtttatgcatctataaaatgagaaagcgcaaaataatacttctacctcatagggttatcgtgaaagttaaatgacagagggataaatgaaatatttagtatagtgcctaccacaaaagccaaagctaaataagtgatagccaagaacaaacacagaaaacttcctaaataaaaatatgactagaataactgcaatgtatggaccaacataagcatgtttaagagtgaacacaggtgctattagtaattacacctggaccaaaagtataacccaggatgctccctgacatactagaatttatggtttctctatctataatctattaacatagcaggcagtaaaccttctcttttgtggagaccacacatgcaccagacaagcagagcctggattcaatagtgtgccagtaactcacccagattttcaagaagtaatatttactgggattatggattaatcagagcttgtgtttaccaaagtaaagttcaccaatgattcttcaaatatgttcacaagctaacttggcttatatccatttacttataaatcagaagattccccaagattttactgtctgcctgattaaagctagtatgtgctataagtgttttcaaaatacttttttccaaaactgtccttgcagttaaggtgctgttaattcaaagtacctatgacttcctatcagaaatgaaaatgacacttaatgagaacaaaacatgttttcacttgaaatgcaattaaaccaaattagagaaacagtgtttttctaactaagataaaaacagctgtgtttatgaagctgctctaatggtattagaatttctcttatggaaacttttgctttatttaagatatatgatttttattttaattgacattttagacaatgatactttcattacaattttttcagtcaagtatttctttagggaatctttcctataattcatagtgagctaatttgatcatgtattaatagagatttcatggagatttgtttttaaaggtttttatgtgaaacctttaaaaggcctcccaacaaaaactttacttcatgactagatatgatttaatcatgattatgtcaaaattgtaatttttaaaatgccttaagaaaaataatttctgcatacatttgtgtaatttttctaaaatgcaaaatttgtaacaatttctaaggtgtagaaaaaacatttacttaagttgctggtttttttaatattcatgtgtatgttttgggattttgtagatataacctatgccttagattactacatgttgatgtgacttgctgatgtttcaccaaaaaaaaaagaatgcttccatttctacacttaacatttttttctttatctttcataattacggtccataacacttggagtaacaacatgttttcctgtgtatatataatataaatggttatatacaaacaatagaagaaatacgcaatttcccaaaatgataacatttgaagacgtcattaccaacaacaacatcactagaaacattactgctgttaagagcttgatctagaaaatataagcttaaactgctctgtttggaaacagcatgtaatcgggatatttaactagaaattcaagtacaataaaatggatttaattagttatgtagctataaaataccttaaatttttttaggctatgtctgcatgggcaactacttaaatgtttttagattaatttattttagtcaatttaattttaataattacctcaactatatgttattttcttcctttaaataatcacagaacacgctgttttaggatcaggtagaagctgagacaatctcttttgaacaaattttatttttattccaaaattaattgtcctaaaaatagtacatttagccatgaaaaagagaaaacaagtaaacctatcaaaatgggacactgttaattaactaaacatagaaaatagattcattcattatccaccaaaaatttcaatgtacctgccaggtaaaagcaccatattcagtaccatgaaagtgataacgattccaataacagaacatcttccctcaaagaacttatcacatgtttatgtataagtttaaatgcattgaatgtcaaaaatgcagatagcgctttgatcaaggacattttagcaatgtattcagacaggatctttattttctagggttttcattataaggcagaaaggttagactaaagagtaatgttaaaaatacaaattatttttgtattctagacatttctataagaaatgtatggaaatagaactgtaattttggcagtttttgtcacagtgtcagtgagcaaatagatgtcatactcatgagtacagaaagaggacattctctttaacagccacatacttcttacccagaaacccttggagaagatttataaacccacatactcagaatatggtaatgaggaaatgctgtctgccctgggaaggggaagaggatctaaaacatttaggacaggtaattccacaaccatgccttaagataaatccatgccttgaaaagtaaaaagaacagcaaaaacagctagttagtcaaaggtcaagatagcaaaccctagctggtaaacttgtctgaatctttactgtattcctcaagctataaactatgtttatagactccttcaaacaggattaaattttggaggcattttcttaaaaaaatagtaaatccccactgtaaaattagttataggctttggacaggattcttgccaatggggctcagaggcttaagttttattaatttcacagtaactccaccttagttcacagatattttcaaaacatggaaagtgtgattgaagtcaggtaagtctaatcaaatatgagttctggtgccacagaacggtgatgttgaaatacttggcttttattggctatttatggcttttattggcatattaatgtcttttactgatgatctcaagttctgtctatagaaacactgatgtctgattgtaacagtttaatcaatgtataaaccaatctggatggttcagatctcaattccaacgtttcctttagaattcaggctcaatttatctaaattgggctcattatattattattaattttactttggctgtgggctgagttaaagcacactatgtttttgagcattctaagattgttccaggatttaaaaatttaagattactttggtttcttggaattatttaatacacactgcaattttccctgaaaaacacatgtaagctaaaatggctctatggaaatgttttatgttttaatgaggttgggaaacagagataaattcacctggtcataatcatatggtaaatattgatgaaaggaacctttttctaaactgcatagctataattctattccagctgattttgtagatttaaaatattttaccctgtttttgtgtctcttaaggagtttctgtttgggttatttgtacagatcaacagataaaaacttatgtcctagaacaaaaacagcacacttaaacacatcttttctttcaggccaaaaagtttgctgtttcaggaccatggacctccttaggaacatgtacatatttccctaatgaatccttaggctgtgatatgttttcgagttaaattgttattactgatagaaaagttctttatgtctgccataaatgtgcattaaagtttatatagcattcaccttcatgattggtgttttatcttactgattattttggcagagaacaaataccaaaagtctccccatgagaaataaaaacaaaccacgaccctctaaaaatagaaaaaaagccacaactcttcaggtcctccttggacccatggacaaggctcataaacctccttggtgtccattccatgttctgtgaatctggctgatggtcaaagaaagggctagagacaggatgatctacaaatagaggagattgaatttccaaatgaggtttgatcatctgctctttgtgaattttttccaattgcttccccatgtgccttggtttagcctttcaaaaaattagaattttatacccctaggatgtaaaataccatgtcagcgcactttttgtgcctggaatgcaccttggagatagccttgcccattgaccagctcttcatttttcagagggagaagaaagtgaggtctgggaaagtaaaatgcctgcccaaatccacagagctaagaagtagcagagcagagatcattaccacacattccaaactttcttcctatttatcatttttctccttgagccccttcttgtctgagacactacatcaattaaaattattttataactgcaacatcgtacaattgccatgtaacacattgcccaatgcaattcaatcttagcatctggaaacaatactcatttattaactcacactttgtaggtcagaagtctgagcacagcatagcaaagtcctgttcttagggtctcaccaggctgaaatcaaggtgttgaccgggccgtctcctaatctggagtgtggagtcctcttccaagtccattcaggttgttggcaggattaattcgttgtagctgtaggactgaagtctcttttcttgctagctgtcagccaggggcagctccaagctctcagacgctgccctcaggtcttagatgtgtggccctctcactatacgacagctacttcttcaaagccaataggagaatatttctcttcaggaaaggttcactccctttttaaggactctgctgatgaggtcagacccactcaagacaatctccctcttgattagctcaaagccaaccgactaacaactagtcaagagtggtatcccatcatagtcgtaattctcacttgtgctcaaaggggaggggatcatacagcatgtgtgtaccaggggacaggagtcttgggagtcatcttagaattctgtttgttgggccgagcgcggtggctcatgcctgtaatcccagcactttgggaggccgaggcaggtggatcacgagatcagaagatcgagaccatcctggctaacacggtgaaaccccttctctactaaaaaaatacaaaaaattagccgggtgtggtggtgggtgcctgtagtcccagctactcgggaggctgaggcagaagaatggtgtgaacccgggaggcggagcttgcagtgagcggagatgcgccactgccctccagcctgggcgatggagcaagactccgtctcaaaaaaaaaaaaaaaaaaaaaaaaaaattctgtttgtcggccaggtgcagtggctcacgcctgtaatcccaccattttgggagaccagcctggccaacatggtgaaatcccatctctactaaaaatacaaaaattggccgggtgtagtggcgcatgccagctactcgggaggctgaggcaggaaaattgcttgaacctgggaggtggaggttgcagtgatcccagatcgcgccactgcattccatcctcagtggcacagtgagactccatctcaaaaaaaaaaaaaaaaaaaaaaaaagaattctgtttgtcacgttggtctgattctactcattcaagtactagatttccttttgcctcctcttaccttctgctgccccccaactgagttggttcattgtcttccatcctacagaaatccagaaagggatgataagagaaggtaaattcagactagggtgacgaaaactccaaatccatgaacatatggcatttttattgggttcatgtattctttgcagctgtaagggcattggccagggataattcagaattaccttttcactaattactgaatagtaaaatttacctattctttgggcatgaagcttcttttaatacggctggcctggattcagagatgtctggggacacctgtgctgggttggcaggagcagcagcagctggaagtcaggggagagtggcaactaaagacctgccattttcttagtgcctatgcaggctgagactttactttcatgagctcatttaatcttcacaatggtgactgatacagtcaatattataatcctcattttacagatgaggaaatagcagagatgcagcagagtcagagttcaaagctcggtcagatacaccagtgctttttcaaggacaggcttctccttctcaggttttggttactcttgttttcttttttcttttttgagacagagtctcgctctgttgcccaggctggagtgcaggggcgagatctcagttcactgcaacctccgcctcctgggttcaagtgattctcctccctcagcctccggagtagctgggataacaagcacgcgccaccatgaccacctaatttttgtatttttagtagagacagggtttcatcatgttggtcaggctgggctggaactcctgacctcaagtgatccacctgcctcggcctcctaaaatgctgggattacaggtgtgagccactgcgctcagctgagacagtgaccctctgagggtctcagcatatttaggcagagattgggggatggcggagggagctactgagtgacaggcaccctctgagagggagcctatctcaagcaatcaaaaaatatcaactatatgtagggactctttctcccttcaagagttacaattaaacttttcagaaatcaagatcaaggctatagatgataaaaattttattcctaaaggaatttatagacaagaaattgattgaaccttataataccccatgatggttcatgagaaacacgtgttcatatgattataccatgtttttaaatatggggaaataaagcacagagtaggtgaatgtgaatttagggacatcaaaatgtaatgacaaaaatcagctaggcttgttcttgaatccctcaaactgtaacttttggctgaacaaatgaattaagatatagctaatacagctgcagagcttggaaaagttacagttgctttgttaaagtatattgagttggagtaaaaagttctatttggaaagatttcaaaacccttcaatggcagcccaatcattccgaagctgaattaaatgtaaattgtgaattatctgcatacgtttatagtctattcattttaatatacatacggtggttgtgtactttaagaagataaaaagatgattcctgaggcatcattactgcatggcagagagacaaacttgaaaacaagtaattataataatgcaagtgttaaactgaagatacagagaaggaatacacatattccacagtcactggttccctttgggaacatcaggaaaaaacagaagaggaaagttttgagttgggtctggaagaatggaactttagcaggcagaaaaggagaagaaaattccaagtggtaagaaaaacacagttaaaatcatagaggcaagaaaatataagaggctagaaaaccatagttcagtgtggccagggtgcccacaatgcaccaggagaagatagaaaagagattgtttatgcagcaatgagattggaaaggacctggctgccctctaaggagaagtttctattttatagcagcaggaatctaatagagacgttacacgaaggaatgacaagataatcgctctattttagaagattaactctggtagcaggagctgggatggctgggggtgtgaactgaaactgacgctgcataagaagagaatttacaagcccagtcaaagaatgaggaagaggacccaggtcagggaagaagcaagacaggcgatgagaataaaggctgcttcagaggtgaacactgtagaattgggggcaccaggtggctggaggcaggtgagaagaaaaggaagatgtaaagagaaaaatgaaggatgatgcctagtttctgatcctgagctctgtctggctttttttgcggggaagagatggagattaatgaattgtctttgggcatgtttagtttcaggtacttggaaatacaggcttgcagtttagaaaacaacttacagctgtagataaacatttacgaattatcaacatttgaggtagtggcaagtaaatgatgtttttatagaattatcatgtagttaagaagaaaacagttttaaatattggaccatgggccagcatttaagagaaagttaaggaaaaaaaaaagatttaagaaaaagacacacagaaagtcatgccactgagattttactatgagtcccaggcaaaggttttaagatgagtgtatcaatgtcccctaggcataaaaaggattaaaaagagaagagttcagatgacaatttggaaggcactggtaaactttgagcagtttaattagattggtggagagttggagacgagacagagtccttgaactgataaacaaaaaaaatctgagagtatttggtagtgaaagtaaaggaagggtcaaaagaaaggttttgttgttgttgttgttgttgttatggtttcttcgatagaaaggggaaagataatggttaattggggtaacccagcagtagagattggcagggcaggtaaaccggcaggataaaggaaggagagtatggattagattttaataaaagtttcttagggaagaggggaagaaggaaaaaaaatgagttgagaaaatatatattaaattctttacattgtgcttctgagacagagctatatttagcacccataataaatatatctgataagaatcctagtatgttgctgactctcagcactctgcttattattatgaaaataaaaatgacttccatgtcattctgtcagactatcttttggaaaaaacaacgacaacaaaaataaaaatgtcattcaatccgaaagcaagagaaaagacaccttagtaaaagtaactttcttcttccacctacaaaaccagaacttgaagacacaaatctcaggtgtactgaaataatttttttgtgcctggatataactgctttatgggatcacagagacttcagtacacactctgggacaaacagattattcacaaatgatgatccaaacatattctaggcattcaattgaataaggcccaggatcacccccagaatttttctctgggcgccaaagaatcctacatgctgaataagaccctaggcaagaccagagctccctgcaccatttgaattaggtagtttccatcttgcacctatgggaaagagttggagccaacccaatctttatgattaggcaggaaaaacaacattttccataagaatgtaatcttctgcatggttggtcaccagttatttgttggacatccatttggtttctgccaagttagctaattgttctgctaaatcatctttaaaagatgacttgccttcttgagttgttaatacttgtgaaattcttttcccaaatgaatgagaattgaaagacatagattcttttaacacacacatacacaaaattcccaaacatatagtgtgttgaaagttagtctgttgcaaagaaacttgagttctaggcccggatccaggggtggagatgactgtaacattccaccaagaacttcactcttggctttcacctcgaaactaaaaatccctagttaagtcagatatatgaagtattgcactctaacatgaggaggaactgaagaaaagggaggatgttttcataaagatttagtgaggaagttagaaggaattatgtgtgaaagaaggaaaaagagtaattgtggtattattacaatacatgcctgggccaggtacagaatatgatgggtccgtgtttcactccatacagccctgttatcatgatgacattatgaagtaatttcctatatactataatctgttttggaaatgctttctaccaggtgtctcttatggaacatacaggaaaaaaaaaaaaagagttgacctattaaattactctcgctgttcaaatatttgaagtactaattcatcactcatgacattcaatttatattttaacatcattataaatttaacagggttgaatctttcaaaataacaaagaaagtgccttttgaaaggaaagaagataggaacgttgaagaggttcttgtgggatcactcttaaaagccatcaaagcatctgaatctctctcttggctgtataataaatattcacagaaaatgaccgccaagtatgtatggagaaatgccttggcatttgctgtatgaatatggatgatgggaatatagtaaaatattagagagattaaatcgaaactcaaagatagttctaaggtgtttactgggtgtcacttgatgaaatgactctatggggatttatcactaatctgtgaagtgaaaaataatcttaatgacgagaggaagcttacctacattatgcctaggacaagaagtttttaattcccctctaacaatgcagtgtttgcaggttttcatccattatcactttgttagagtatctttgctaaaacccaactattttataggctcctctgacacctcacaagaatccaagggaggaaatgaagccaatgaatgtaatctacaggtgaaatttgcagagcaaattcaggaaaaaaaagtaattatgcttcttcgcattttatcattttataacctcaccttttagagaaggtattgagagattatactgattagtccagatttttattttacatatttgttcatggaaaggcttattttaacagaagttatatcaaggtgtcatgcccagtaccatcatcatcatcatcaaaaatttgactgaataaacctaagtacacacacacttctgtatgtatagtcttacatatgaaagtaatatttattcattcaccaaaaagtgtaaagagaggttaaaacaggatgggatgaaacagtgtacaaaggtaaggaaaagcttttccaagcaactgaatttcccttgaagcctgaatgttaagtggaattaggcaaagtgtggtggttgtgggaaaattcaggcagaggatatagctagtgcaaaggctctaaggctgcaaaggatgcaagctatgcaggcatggtgcaaggaggcctttgtgcaggaagcaaagggagataaggctggggtgacccacagcctccttcttcaagggcactggatagactcctgggaagcaaaaagtgactggattaaatttgcatttcaaaaagactcttctgactacagtatgtggcaagataattgggtgaagcaatagtccaggtggaaagctttattacagtcaaaacaaaaaaggatgaagacttggattggggtggtacttagtgaagaggcataaaagaagactgaagtcaaaatgacaggacttggggatgggtgggccacagaaagaaggtgtcaaaatgattgtcacagtaggtaattagtcattgattgatagaaaatggtaatcactgaactaggctttttatcttcattctgttctatttaggttcattctatccaaagtatttagtgcttaccagatgcaaagtacagttaggaattctaatggatagaaatataaaataaatggatacaaggttatataatctctgccttttataggcttatattcaaatacagacaatgctttccatttccagtaaagggaatgagaaattatatacccagatacatatatattgacacacaaataaacagatgtatacacatgtatgtctacatatgtatatatgtatgtacacatatgcatatataagtatatatatatttgcatcatatacacatctaaattaagggtgcattgccaggggactgaggaggataaataatgcagaggtcagaaaaaataactgaaaagttgtgtgggatggtattcttcttataagaaattcaaatgttttcaaaaatgattgtcttatatatctgccttattacagaagaaatgtatgacgttggccctgtttatcagggccagaagaagaaattcagcaatagtatttagcagtattaacaattttaatccatgatatcagtcatgacactacaatcctgacagtaatcttattaatagtaatgataaataatagtaatcattagtatgtagtaatttttaaaagtcacacaagcagaaaaacataaacatagatttgattttaatgttgtttgaacattgccttttagcatttttctttgaattctaagctcataattttatcataaaactgtctttacagcagacaatgactaattagtaattctattaaatatttgccaaatggagggtaccacttctagttttgccagagtgtcttgctggtcagaagtgctttgcctaataaactcaacatgcatgttgatgctaagagtctaactgaacacacaggacaatcgcaaatctgtgaattattaagcctcctttcacctcaatttcctccctcataggatggtctttgcttatctcagttttgtgtgtattccttttgattgcttgttaatgtctcctatttatagtgatattatgtaacagtattatttaatctccaaaatagtatacaattgtcaagtaccattgctgtaattatggtgcagatgttggaatatgcttggaatcactaaaagtgaatttaccataagctaaggaagcttactcttcagggactctgacttgcaagagcctatttaatttcttattacctaaatttgtaagtttaattttgcagtatttttcttttaaaagatcccccaaattttatgagcttcatttccagaaaactcatctggccttgtttttcatattgtattgtcatatttaatttgtttttatgcctttctcacaatattttaggttcatgagatcagagacagtattttatttgtttctctactgcctagcttattatttatttatttatttatttatttatttatttatttatttattgttatgagacagggtctcactgtcacccaggctggagtgcagtggcacatttatggcttactgcagcctcaacctcccagggctcaggtgatcctcccacctcaacctcccagtagctgggactacaggggagcaccactacacctggctaatttttgtatcttttttttttttttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattttgccaaaaatgcaatttgtcttgttagtcttctttaatttttccatgttttaaaacttttcttggagtatttcccaaatgggatttactgagaggatatattcagccagctttgtagattctaagagtccttctaaaagttaagtctagccaaggaaaaatgtagtggcacacgattgcgtttctcttacgctgtcatttaatgtgagatctaaattttgcatttctttaatgcccaaggtgtttattttttaaaatctgtactctttttatcaggagttatgttgacaatttacctgggagctgatataccctatataatacatgatctaagacctgaacaatacacaaattaataaaattaaaccattaagatatgtcatcatttctaaattatacaattgggttttttttttaaagcaaaaatattcttcctcttttctccatcccttgttctggtcagttccaaggttttttacaaatgcaaaagaaattcatttgctactcctgaccacagagatgaataatttaaggacaatatcaaattcttgataaatctcataaatgttttaactgtccaagaaatggacatttatttggttaatcttttagctggccataaataatgtaataaaaccccttaaaattaacattaaataacataaagacctaacgatttttagaaaaaaacctttttggactgagccttgaatttcctgagaattcagctacaagtgataactaaaatgtaactcgagaatctggatatggttccagaaaggattgttgtcatgcaattgccatttcatcatctttccttaaagtcccttcaatatttatcattgcaatttttgtcctgtcttttcccctccatcacatcaaaccaaggaaaaacaattattaaatgctcatttatactcacctccctcccttcatattcattcattcctcagccctaaaattcctgtaggaatcctgcttttacgttttatcttaaagccaccatagtatctgtaatctcttttgtagtcatgtatgcttaattttggaagactgtcaactacctcttcaggttcattcaaatgaaaatgtatcacaaaatcgtaggctcttcccctatctcactgaaaaattactctaaaaatgaccagtaagctgttttgttgaagcaaaacatccagaccctaaacaaaagtagcagaattacaacatttccatagaaatggattttgagcttcttttttttaattggggaaaatcttattttttaaaaaagaatcccagaatacatctttgctttcagtccttcaattctaacataatgccatgttagagaatatgtggtagtgtatactaagcccttatgctgtctcacatccttgggacaaaatatctgttttgaaaggacttctctgaattttgctatttcctgcttactgagcagtggccccctcctgggaaaacagagttatttcagccagtgttcagactccatcttgcatacgtctctgtggaatattaatagtgctactgagatatattcatcatcttttctctgcttttgctgtctttatagcccagtgaaatttatatttggtgtttgtaggaaggctatcagaagctacttggacatcaaacttttaaactataaataatgatggcaagactgctaggatatctttccacagttaaacccattcaacagagtttcgttcttatgacagtgcaaattaaactagaataaaattagtgtgattttaggacagttttaaagtgaacatatttccctccctcccttcccatctacatatcaaggagacactccagactgcacttttatttaaattgcggccatcagaaaataccgtgagaaggtagtgtgtaggtaatggttcagttagcattgaccccagaaaatggaaaaccaagagcaagtcacttttaaagtgaagcaatagattttgaatatggattgttccaactcaccacttcccgaccacaacacaagagtatttcactgtaaattaagagtctaagttaaccacagctgtggtataactctgagaatgttttctctacatgtagacaattctggatccttccgtggtgcccgttaccctggtctttaacttttgtcctttgcaggggaggggtcaatgccttcttatttccttgctctttagaattctccaccagagggaggacaagggaaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaactatattattaatcagaagacagcttgctcttactaaaaggagctctcatttactttatttgattttatttttcttgacaaaaagcaacagttttagggatagcttagaaaatgggttctggcttgctatcagggtaaatctaacaccttacaagaggactgagtgtcactttctctctgggggaatgatccagcagcttatctagttgacaatcaaaacacggctgataaaggtgcaatcatttctgacatgtatttttcactgattttgaagctagtgattggttgtgtcttcttggctcaaaaagaagcatattacggcacaaaaagcccagcccagacagcacatgcagcattttgtctgaaatacttctagagtcaaacgtgcctgctgtacatagcgatgacttgtcatcatagggaagtatttccatcgtagagtgttcagaaggagtgactgtataggtggagagaagcttagtgactccgttgaaattttaaaatgtggatgaccacccctttctcccccttatttttcttttatctttccatgttgccttgatcaggtcataactatgcatgaacattttttatcaggaatggccgatgtgtatgtgatttgtaatcacaagtaatgattcatcaggaaatgtcaatcctgttggaaagattgcacctttacttgcagaagtgacccccacctgtgtcctgacctctccatttacaggctctctcacccatttcccccacctcctttaatttttgctttactgtcataaagtaggactaagattggtctaagcattgcatgttcttttgtgatggtaaatccaaaggaaggcctataagtattaacatttgaaataactgctaattcaggaaaatggaagaaaaaaaattatttgaaacacagaacccatttcatggcctgcctgatatctgtgaaatcagggctggagctttacttaggattcacatggcctcctaggaaccatgggacaaatgggaaacaggttatcgggggattcatgaagtcagtgagagtaattgcttcttttttgcgggtgaactgaatgtatttcttcaccaaatcttgatgttaacaattaaaaagaagaaatgacatgcaagtaggtcttagcagaaaaatgcaggctgggcatgagtcatgttgttaccctcccacatgctcctacaatccacagagatgcctgtctgcaggttcttgaagttattgttagtatttggtatctcaaatttttcgtcactgttcacatgccactttctctgtgcacagtggtatcctcatttgctttttaacctacactgaggagtctttgtcaggttgcactgattttccaattctgcagtaatgagtaagctcacggcatggggaagaagacagtcagtccaatgaagttctctaaattattttaacattgcctttgaaggccttgactcatccttagctatttcaatgaagaaattcctaccatgaatttaaaaccctaaaaatt

SEQ ID NO: 43 - DNA, 11300 bp, Homo sapiens
tgttctaattactaccttttattctaatgtgaaccatggccctgaaagctgataacaagcttggctgagcagagggaactaggggtcggcagaaaggattatgggtggaaaacattggctcttccttggggagtgatgctggggaaagggaagagagtggctcagcctgcaggtaaataggctagaaaagccaaggccaaaggctggaggggagaggacagtcagcatgtccagcctggggtctgggtgtagggttatcccttctccctgtgccttcccatctcgtccatgagcctaggtcttggagccttgtgttggaggctgctgtgatgtcaggaacggggatctgtctagcttttggccacttcctgggacctcacgcccctgttgacagatggagattgggcagcagggccttgctgcattgttatctgctgttccgacttggtttgtcttgtccaagggtgacgaaagagccaggcaccagggtctcatgggatgaggtacagggtgggagatgggggaggggctgggggctgaagggagcaagaaagctgtagctgtgtggggctggcaggatgttgaagaccgcctctgctgctctcacatggggactggagagagaagcagcaggttgaggttggggtcacccatttgttgtccctgcccctttctaacatcctggacctgcagagcagttaaggactgtccaccctcccctgccccctgctcaggtccaataatgaccatcatggatttgtgtaactccccacagccccccaaccctgttccttcgtctgtgaaatggacatcccaggaatgttggagagtggcccagcgtcacactccttcacctgcccacaaaggagctggccctgctggggatgagctgctggtgaccagatgcccctctgcaaggcccttacctgggcccagatcctgcttggtcacacccagcccagaagacgggtcctccagttccagtgactctgcaaaggagcagcaagtccgtttgtcacttgaagtgcagcctacctgacccaagatgcctgagggcagtgcttcccacctagccacaggcttagtgcctgggaaagcaggtacccagggaaggacagctgcaagcagcaacaaagaggtgtaatgggggctcgagtgagaagggggtgatgaaatgagatgggtgggtctgtaggactcctggatgctagaggatggcgcgtggatggatgaaattcacagatgaaaggactgacggataagtgaacaaatatgagtgcatgtaagaggagagatgataaatggacaaataggaatgcacaggtgggtggatggataaagggctggacgcatgactacgtcactgcccccaggagctgccatcctgggtgtcctggtcccatgtgcttcagaggggacctcttgcccctcaaccttcctagtccttcctggtcctctgacactggcacagtgccactgcttaccactgcagttatggtgcccgcggcttctggtgttggggacctccgtgccgttggggaagacacaccagcagtagccgatgctcccatagcactggagtggcagatagttgccgttctcgtcgcacttgggcctgaatgaacccgggtggacagcagggatgtggctgacctcttcctggcacttggtcagtactgaagcgacaggcatgatgaggacacagtgagtgagtgagctctgaaccagggtctgagcagagctaaagacccacacaccactgctgtgggcttaatgccttcttcccaagtggctttactcactccagccatcacacggatgggaaaactgaggcctagaccaacaaggtctgagatcaaaaaggaagtgaatggccatgtgtccaattcacctcagaagttgatggtttcttctgacactcaaagcccattacagttttgggccaggcacagtggctcatgcctgtaatcttagcactttgggaggccgaggtgggcggatcacttgaggtcaggagttcaagaccagcctggccaacatggtgaaaccctgtctctactaaaaatacaaaaattagctgggcgtggtggcacatgcctataatcccagctactcgggaggccgaggcaggagaattgcttgaacccgggaggctgaggttgcagtgagctgagatcgcaccactgcactccagcctgggcgacagagccagactctatctcaaaaacaaacaatcaaacaaaaaaacaccattacagtttggaattgcacttgcgattctgattctagagaaaagcaatgggcaccttggtaagtctaagcttcctgttactgggagttctcaagtagaaatggggtttaccgtttgttggagatgtcttagaggggtttaagcatcagctaggagttggagatagcatgtaaggtgccttctatgaatctgatgcagaaactgaggccccaggcagggtggccctttgaccttctacttcaggaccctgaatcctagagggaaggggacttgtccaaagttacatagcaaattagagacagcaccgggatagaaacagcactctgtctttgggtctaaaaacatcctagtctgcattgtccatgaggtgggaaacgcccaaggctctcttggcagcagctgtgaccttggcgccctcactggattgcgggcagcactggggcaaggtcattacaaggattcctttctgcagtgtttcgggcaggttctaccccaggcaccctgtgctgtaccatcctctatgagagaggtcacctgtaccctgtggtgacaggcctctgtgggcccttaggaacccttagacaagatgggggtgggtcaggggagggggacagccaaaccaagaaggaacagacaggagagagagagaagtgagaaagaagtgagagctgagaggatgggagattccgcggtgctgggaccagggagtgctggaggccccggcctcagcagcttcaggagagccccgagggtccagaagccctggcacgctaaagctcccactccctgtacctttcggtggagcgtcagtgggcttttgctccaaggagtgcctgctcatttcaaacaggagccaatggtgcatccagctctcaaagacctaatacggatagaggtggaggtcaggttcgatggccaccaccaagcccctacactgcctggctttgcccctggggacagaaacatgcagggccaaatagggccccaacacccgggtccagctgcagcctggttccctcttaaagacccctggggctgaaccccacatactctgcagcatccaggttttggaagtgctggtaaaccccttcagcttcctgagaatggcttccccagcccaccctcaccccacctctcctagccctgccctagacaccagaggaaagagagagttcccatgcagggaaacctgctgaccttccagtctatggtctccatggtgttcttaaggtgtctcaggttctccgggaagctccccttcagtggcgggtacaccttcagggggtcagcattctacagggtagcagggcaggaaggatggttcaagaagagctccctggcaggcagtgtgaaatgtgtagcccacgttcccttggtcttccattctgaggaatggaccagagctacaccaagcctaaaccctggacttcagccatgatgggaggggaggggagggtacgggtaagggtagtccagctgttcagctacgagactgcagcgttgcgagtcgagttccagattccaggccagctctaccaacaagccccagtgtcctccctgtggatggctgctcagctttcaggtcttacctgctccagcaggtgaggacccaaccttgactgcccccagctaggttgagtcctctgcctctttcttcacaaagccccctgcacttctgtcatcacctggtcacttgtctgtctcccacactagcctgggatccccatggcttcaggagctgggtccaattgctccccattgtgggcccagagccttgcacagtgctggcataggacagacacgcagtacaaatttggggagaaaaaaagggtgtcttgagcaagtcacttccaaactttgagcctcagtttctttttttatttttattttattttattttttgaaatggagtctcactctgtcacccaggctggagtgcagtggcgtgatgatctcggctcactgcaacctccacttcccgggttaaagcgattctcctgcctcaacctcatgagtagctgggattacaggtgactgccaccacatccggctaatttttgtatttttagtagagactttcactatgttggccaggctggtctcgaactcctggcctcaggtgatctgcctgcctaggcctcccaaagtgctgagattacaggcatgagccactgcacccagccgagcctgtttatctcaaaaatgcagaggccagactacatataacatttaagggtcacccttgtattcagtaatccagagagcacatgttgaaagtctgccatgagccaggtatacaggccttggagcttggcccggccagggtcctgggtgggcaggcaggaccacccagctagctccctgcactcacctggagcaggtgcatcacatggtcctctgtcatgttgccatacttggtggcattctgcatgggctgtgggaggaagtaacagaaggttaccagagctggtccctggagcagggggtatggagcaggagccggttgctgggatctaggtaagagactggaatcgcaggcacttggtcaatggttccatctctgccacctccaaacatgagagctcgagcaagtcactttagcttcctgcctcaatgtcctcattggtcaaactggcataagctttcctgcccagggttttgtccacagcacagtattgtgaatataaatattgtcaatgcatgatagcaaggtctttgagaatgggagaggacagtgagatgctataggaaatgagaagcactttgtaaactgtagagggctgagccttcctcccagggatggcaccaagagactcttcacctgtgccctccacacctggggagcccgattcttcctgaggcaggcactgtccctcccgcagcagtcaggacccctccccaggtgggctctcttccctgcccctccccttggcactgtcctccatccaggcgggataaccttgcccctcccaccaccctggggctgtccttaccccctggggcagggctcccatgggcagcgcctgcatcagcagcggggtggccatgcgcatcttgctcacaggcttgggagctgtggggacaggaacgagggtaagtgtggccccggtgcccagggaggagggtatcagacccagatgaggaagggctggaattccaaaccggagggagaggacagtgggcccagctgggtgcagggatgcgggtctctgagttgagggatggtgggaggtggggggtatcaggatgtaggggtgcacgcacgcttgggaagcttcatgcgcaggttctccagctgcaggttctgggaggtgactgtcagtttgtccagccggccctgctgctggtacaggaagtaggcggtggtggcctggccagcgaggagcagagtcaccaggatggaaaagcctgtgtacagggctccgcggctgcacttgctgtgggaggtggggaggataggtcagaggaggatccacagtggtggctgccccaagggctggctaggaatggggaaatgtatacccccatctccattagacccctaagccacccctaataaacaatgcatttgaagcacaaacagtaagctggctatggaaacacagcttgaagacctcaccccacccctccttccaaccatcgatgtgcctgaagtcttccctggcagagaccctgcagctgccacgggcctgagttgaacagagaagagcaaagaggcatgctctttgtcctctctggaccttagggtcctgcctgtgcgatgaggggttgaggtgggggggtcttcccaggctccctttgccgtgcggatctcctgatgatcagggctgccctcaaggggaacaggtttggtttttgttttgttttgttttgttttgttttttgagacggagtcttgctctgtcgcccaggctggagtgcagtggcgcgatctcggctcactgcaacctccacctcctgggtttatgccattctccttcctcagcctctccgagtagctgggactacaggcacccgccaccacgcctggctaattattttgtatttttgatagagacggggtttcaccgtggtctcgatctcctgatctcgtgatccacccacctcagcctcccaaagtgctgggattacaagcgtgagtcaccgcgcccagccttttgttttgttttttttttctgctggcaggatcaaccaggtatgttattttttttaattgacaaaaccaaaaaaaattgtatgtgcttaccaagtaaggggaagagggttttcacccctctgcccaacctcccaccctcacagtgaaatcagatttaaggagaaaaggtaaggaagtgggaccgggacagcagaaaatgtagcccacctgggaagaagtggggcctggccattttaggagtgggctgggggaggcttggacaatgtcaggctgaagcagggccaggcaccacccactctggggccatcctctgcccaggctctccatgtctttgagcatgtccctgccaatctctgtgcctctgttccctcatttgtcacataggtgcccccacctctgcgattctagaatttggtgggtttcttcttttaagcaagatctcactgcaagcgccaaagtatttcaaatggtaatatccatcctgcagggggtgggcaggagtataggtgcctgagcctgtgtggcctggatgaatttctcatgctccctggactcaccatccagaccctcggacctcagcaagcccttgtatctgtgggacttggatgcgactggggggtgcatgcatatgttacagtacaggggatgtaaggatcctgcccctacaccccaggagtttctgatctgttctttgacgaccccaggggtgggactactaagaccctagtccaggtgttgccaatgtgaaggtgttgggaggtgatcgggccacaaggccttctccctcacgaatgggattaggtgccctgtaagacggcttgatggaaggagttggttctctcttgcccttctgccttccaccatatgaggacacatcaaggaagcccctcaccaggctgggtgtggtgactcacgcctgtaatcccagcactttgggaggccaaggcaggtggatcacttgaggccaggagttcgagaccagtctggccaacatggcgaaaccccgtctctacaaaaaaatacaaaaaacttagccaggcatggtggcgtgcacctctagtcccagctacttgggaggctgaggtgggagaatcacttgaacccgggaggcggaggttgcagtgagccgagatcacgtcactgcactccagcctgggtgacagaaggagactgtctcagaaaaaaaaaagaaagcaagctaggccgggcgcggtggctcacacctgtaatcccagcactttaggaagccaagacaggtagatcacctgaggtcaggagttcgagaccagcctggccaacgtggtgaaaccctgtctctactaaaaatgcaaaaattagccggacgtggtggcgagcacctgtaatcccagctactcgggaggctgaggcaggagaatcccttgaacctggaaggtggaggttgcagtgagctgagatcatgccattgcactccagcctgggcaacagagtgaggctccatctcaaaaaaaaaagaaaaaattagccgggcgtagtggtgggcacctgtagtcccagctactcaggaggctgaggcaggagaatcacttgaacctgggaggcagaggttgctgtgagccaagatcacaccactgcattccatcctgggggatagagtgagactctgtctcaaaaaacataacaaaaaaaaaaaaaaaaaacaagaaagcccctccagaactgtgagaaataaatttctgggtgttttttgtttgtttgtttgtttgtttgtatattacgcagtctgtggtattctgttaaagcggcacaaaacggactaaaacagacccattgggaactgcaaggatgaggctgcaccctgcctactccagcaaccagcaaggatggtttaggacgctccaggagtcccttgtgcctggtaactcatgacatcacagactggctcattctcattggcttgctgcgtgccagtctgtgctttctgggataaggcccagcccaagggagagttattcgggaaggaaacagcaaaaacccgacggtgggcggggggcgggggggaagtggggagaccagacaggaagggaaaacaaattctacttcttggccttctcaaggaacacgggtggcctagcctgtgttcaggctctccagcctcatcctccacctgttcagtgcttctgcaaccccacacccaattctagccccagctctacctcccacacacgacatgggacagtaccttcccctctctgcaccacagttcctcaggaggcctaagaacctagagattcaccctgaagacgagaccacataacctggattggaatcctggctctggagtcggttagttctgggaccatctaagttgattaaccctctgtgtgagtaaaatcgggtaaaacatctgctccaagggctgttacattaaataagatgatgagggtaaagctcttggctccacacctagcacattgttagcactctataaataaattacactcagtgcaattctcaggggagttcgtagttaagtttagcatctgcttttcttcctctttatgcatcttgaacgcctgtcccctggttctggtagagtgccaactcttgtcacccccctctttatttcctcatttacactaccttcttctgcaattaaaaaaaaaaaaaaaaaagccaaagtcaggagccaaccagagctagcaggaatcgtgacacagatgttgccaggcagaagcattcacaaaagcctccaaaacaggctccagtctggaatggcctaagcacacatagccagctttagaagcagtaactgaataaagggaaaactagacaaggattagacaaggggacatgcactctgaacactgagcccacctgggtctgtaaatcactgagtggtctgagctcagaggggtctcacctccccttcccacaaaatgcacctctgaaagggggccaaatggtggagtgagctaacactttgatgtcagactagtcctggttcaaattctgcctccaaccactcactagctatgattacttgggtaagtcacttaccaatatgacctcaatttcctcttctgtaaaaagggacaacaaaagtacctgattcatagggtgactgtaagaattaaaattgagtttagcctttacgtatgtaaataatcacagtactaactaacagtggctgaggcctggtgacaggtacacagtggatgagaactattatggctattatattattactgagactcagggagaggcagtgatttatccaaggtcacgcgtggcctagacctgaatccattcctcacaaaacagtctccctccttgccatgggattccctggggttttcacaggccacagctctaatggtctgcagcaggttaccttgttccccagaacatagcttgtcataacatctctgcagggttctcccaaacccctttctgcctggcaacagctgacatcacacctagctgtaagtccctgtagatcgcaaattactttttggagactgggggtagcaggggcattggggtaatagccttctagccctttttgagggaaacacatgggtgaggctattttggggctgggaagtgggggcctggtgtcccctggatggctgtgctggcctctggctgcaagggagaggggcacaggcaaggacatgacccccgtcaaccctgagccccctccagaaatttaaccagagcctgtccctcctttcttgcctgcccccaacatctcacaatccctcctgtgatggcagatgtctccatctactctacagacacctgcaactatcattcccttgatccgtggtaattaggagggaactcctctgtgaagaactgcttctaccatcctcttttagaaactctttctccactgggatcttgaacattttcaaaatctggtgcaaggtctttatttatttatttattttttttgagacagagtgtcactgtgtcacccagggtggggtacagttgcacaatcttggctcactgcaacctctgcctcccaggttgaagtgattctcatgtctcaacctcccaagtaggtgggattacaggtgtacaccaccacatctggctaatttttgtatttttagtagagatggggtttcaacatgttggccaggctggtctcgaactcctggcctcagctgatctgcccgcctcagcctcccaaagtgctgggattacaggcgggagccaccaggcacagcctgttccaaggcctttaacctagcattcacagcccagctttagtgggatctcaaagcccctgcatagcatgtgaaactctagggagagaacccatgctctcttctgcttttcagaaggaggcggtgtgatgcaaggaaagttacaaactcctgctcttaaaggaaccccctcatttgacaagagagggagccggagcccagagcaggccaaagacttgctcaaaatcacccaaaaagtcaatgttagagtcagagcctgaatccctctttcctgtgactcctggccggtgcttcttcccagcacatgcgcacggctctgcagtccaggatcggtgtgccctttcctggtgctcacacatacctctccggggccccagggcgccggcccagcatgggcagttgctcattgttggagataaggtcgcgctggtcatccatgactggcttctgatcttcccgacagctcctgcttctcctcctgtgcatctgggaccctgaccccccggctcgcctcttaaagtcggtgctggagaggaatctgattcgtccacagaaggccactccgcccacttggtagatgtggaagtgaaagctacaaaggctggaaataccccactttggtgaagctgccttttgcggggcaggatgtggggcgggggggctccccaggcag

SEQ ID NO: 44 - DNA, 177738 bp, Homo sapiens
ttgaaatacaggacttttttaatctagtggttctttatttataacgtaggctgaagcaattgttacaatgtaggagggagacacattacacaattgttatttatacaagtttagaacaaaaaactgcacagggagaggtcaactctcagtacaaactagcaactaaagcacaataatttactgttagaaacgatttctttctttttagctgtgacactgcttttacaatatgcaaaaacacaagcagaactacccaaggtgtgttgtcacattctttctacattgaatttggcaacattttatttattcagattatactaacgtttaaaaactaaacaagtgaaaagctgtaccaaggtacagttacatccatttatttcaaaggtttaaaataccacttttatctattgtgattaccttgcagcgatttctgcttttgcaaaaaccatctcaagcatcatatgcacaatgcatcagctacttttagtcatcaagattggtgggctaaaccacaggcactactgttgtttatattctgtaaaaggagcttgtttttcaaagaaaaaagcttaaatagtttctaataatcatgcctttgctttaaagccgtaacataaaatgtccttgagcaatcgcagcagtgttcaatgttaatatatagaacaatgaccatacggtacgttactctcacatccaatgcagttatgtgttaaagcataagattaggtaattgagggttagagccaacaggaatctgcagggtgtatgaaacccaccaaactcctcctctgccttgagagggttcggtcagaaatgtgccctgttatgacctgactgctaagggacttgcttgctttcttaaacactattgtcttcaaatgtgatccctttaaatctacaaatctctgttggctttaggggatgggcagtataacaaatttaacttccacttagaaaagacaaatcttttccaaaaaacatttacccagaatacaaaaaaaggacagtatagtggtcagattcccagtgacaataaacaaatcctcctctcttcaatgtttactgtaaagccagttaactgccatttatttgaaagaagaaaagaaaaacaagcccccagattggtaaacacattggcaagttgctagactccaagctggctacccttgtcaaatctgttcgagttttttcaaaatacttgggctttttaacgcacccagcctgctgggcacagttaagtaaaaggcatttactataatctaagaattccctgctattatcatttttaaatgttttcacatttttaaaactgccttacccttttggatgtatttggattccataaaggtgagtacaatcaacgagaaactgaagtgggagattctacgactgcccagaggcagcagcatgcatggggctggttgtgggtgctgtgtgcagtccagaggaatcatgggagaaaggaagtcaagtccttaaacaccctacagaaacaaacactgcaatccagtatggcttattcggatgcatttaccatgaagctaccagaagaaattcaacctacgaggctactcttaaatgtaacaggatcggctatgttgacgatgtacccctcccatggccctccccccaatcccaacacagtctaccatttccagatttacttcactctgaatattgctcatcaattgttactcctgctcttttcatccagaacatagtatatttaaatgaagattttacctcttacccatttagtttgtacattaaaataacttgcatttgcttctaagctagactactacaatgcatctacaaaagcttgtggggaaaaaaaaagaagagtgaagtatagtaaatccttttctaaaattaactacttcgtggttcccctgccccaaccccctttatgcatttaaaattttacaaagacttgtaaaaaagttaaatggaatttggcaccttcagaaaaatcaaaagggaaactaagattaaaatgtgcagaaagaaaattgtcaatatttacaaattaaaagatcaagattatgtcagttacataggttggttttaattcttatctaaaggtgtcgagtactttcaaaagagctatattccgagttgcctacaaaatcttttgttttattatagagtggaatggatcaagacaaattaggttttattaatgaaacagttcattccccaccggcgcatttcttgtgaacctaagaaaagcgaggggctgagcgatcgtttgtcgtggtcttcttcagtttcacgccccttcggatggcgttcagcatgtcttctccttgtggagtatcccttgggctcaggtctgcagggtcactctctggaatctggcctggggagacagtggcacttgggggttcccgttcctggtcttcagcttcactttctggaattgcctgtctgtgctcctcagggatactgggcttcgggcctggaagtggagggttaacggaagcttggccgctccacattgaggagggcatgctggtgacaccttgggggccctcacccacagatggcgactcagggctgtgctccccccgctcttctggcccatctggaggggctggcaacacccctgggaggtctgggacggttggggtcttgacagggatcacgggtgtcttgatggggatgggaccagctccaatggttccccggcggacagaaggcttggtggaaggggtccgtcggatagttgcaacccctggagtgaccatagcaggtcccagggtggtggggaggccagcagttgaggctggacgcttggcttggaacatccgtcggtaggactggctgatgtcgctgtttcttggaatggtggaggacttgtcgaactcctgctgatctgcctcctggtcaccacttacagagaaataatcataatctgaaactgattataggatttgattagacatattcaagacagcagctgtgcttttttgattcttctgggctgggaggacaaaaggcacgcaaggcagggtacacacacagtctcatcccaagcttcccccaggcttctctaccatcttcagaaagcctcaccaactaagaactccgtggcagggatctttgctttgttcactgatgtgtcccaagtacctagaacagtgctggacacggtaggcactcaaatatcgtcaatggggaagaaggtaaagctgctaggctgcagcgaagctacctgcaagcgtctctgggaggaataagggggatgaaagaagacaaattctccagtccagaactcaacgtgaagatcaaacctcaaatagactagcctaggctataacatctccctgataattaactggagaggcaagggctagacaaagaacaaagctactgacagtgagtccctgacaataagggacaaagacagtttccatcagtgtcatgtgctcacttccttgtaagaccaatctcaggatgatgtgggagcttacagattaaacagctcacagccctgattctgaaccaccgtactattgataatttgggctggatagttctttgttatggaggacgtggtggggaggggccgtgctgtgtattctgggatgtttaagcaatatccctgccctgtgcccactagatgccaatagtacccctccagttgtgacaaccagaaatgtctacagacattgccagatgtcccctggggaataaaatcaccctccaataagactcactgtcttagaggttttgaatgatgaatggcatagcttttggtcaattatcatagatatattctagctgttagattttcatcttgcctgacttgtgtgtgcagtggacttgaggatgaaggaggcaggtttgatagaggatttggctggaataggttaagaacttgggcattacactctaacacacttaggttcaaactccagttctacttattggttgtgtgaatatgagcgagttattgagccttaatttccacttctgtaaaataggggtgaaaatacctaccccataagtggctgtaaagattaaatgagaaaataaccataaagtgtgtagtgcaaagtgctaaaacaaaaatgaagctattcctttgagacagggtctcattttgttgcccaggctggagtgcagtgatgcagtcatggatcactgcagcctcgacttcccaggctcaagcagtcctcccacctcagcctccagagtagctgggaccacaggtgtgtgctgctacacctggctaatttttgtattttctgtagagacaagagttttgccatgtttcccagactggtctcgaacttctgcagctcaagcaatctgctcacctcaaagtcccaaaatgttgagattacaggcgtaagccactgccctggcctgaagctattcttattacagcacatgtctccattcaaattggagactgctgtatatgatgctgcaaaacgcaaaaagctgtgaaagtccagatccctttatttattattatttttttttgagacagagtcttgctctgtcacccgggctggagtgcagtggcgcgatctcagctcactgcaagctctgcctcctgggttcacgccattctcctgcctcagcctcctgagtagctgggactacaggcgcctgccaccacgcccggctaatttttttgtatttttagtagagatggggtttcaccatgttagccaggatagtctcgatctcctgacctcgtgatccacctgccttggcctcccaaagtgctgggattacaggcgtgagccactgcgcccgaccccagatccctttcttatatggcagctacctgacaactacagatgagctccccaaagcattcccagatgacgaaaacaatcctgacacctgttagttagcgagtggtgggttgtggttaaaatggaccagcagttttctatctcctcacctggtgctgctcagaaagcctaagtgcacaccccaggctgcctcgtaccttgggaagggatggtgtcctcagagcagcagggggtggttgtctgggtgctgtagccgctggagcactgaagcgagtcccggctgctcctctgggtgtccagctgcaggccccgagacagggccagggccagctcctcacaagcctccatctcctcaccaggctgcaggttggaggagagaaatacacaggttgctttagggggggggctcaacagcactcctgttctgcccccgtgagcactacatgtctgtggggccagggggctattgacttgcttgggtcccactctgaccctagaaagttctgcctctctcattcccacacaaggtttttttcccagggactttgctgtagagcaggaagtcagggaatggagcccaggtccctccagctgcaaggctgccttggccccccagttgctggccagaatgtgatccccagccaggctgaggtggccccaaccagctactgagaacaagagcatcaccctggtggcagccgatacagtcatgctccgtggtctctgagcctcctcagctgctgcaggtgggccgctggcggtagtgggtcctcccccgttggggtccggttctcgcttctctttgcggcgctgcagggtgttcaccagaggctggtcatagggcccaggcttagcccagtcctatgcaaaacaagtgcggtcaggagccagggcctctgcctccactggagggctgcggggaccccatagacagctccccagagaaggcagctggtccccttaaggggaacctccggctgggacaagccacaggccctctgcatgccctctccaggctctaaagggcaaggaatggaaaccctttgggagccccctgtgtacctcccttttcctcgtctctgcccaaagattaaaaaccctcacccaccaggtggcagcaggagacccggcagccacctaacaggtgaccggtgtaagctaaggggacccaccagtgggcagtacatcgtgcttctcctgtctgaagggaccagcgctccttaacaacccagatggcttcccgttaggggaatggccaccagcgagcactaaagcaacatcagcccttctccctccattcccaggaaaccagcctcaaagggcatggcaggctccctgccctctcaagccctcagaaggaaaggaaggcgcccaggggcagtagaaagattccgagaagccttgagaggcccacaccgcctgtgagggctaaagtcaaaacctgcttaaaacgctggcagccaaggggcctacttttcaaattagggtcctcctctcaaaagagagcagattatcctcctggaggagcattgatcggacttgctaggggatcattttcaaagttcgtctttatattaaagcaaacatgtttgaacactcaagactaaaactaaagtctgcgtgtactgttaagttcaacatgatcaccccaaacctgctttgggttatggttctgttaccacagcccagcagggagctcattagggaaaatgggaaacatggccagaaggaaagtcccccctaaaccccctagaagctctgatcatgctgacaccctcaggtggcccccgggagggaccaacccatagatttcaacttgatgcaaaactgggcctttggacttggaattgccgctgcctgcggtgcacactgcactgccgtccatcagggattgaccaaagtcccctgaaggaagaccctcagccccagctacctgtggaaattgctgtcttagagctgccggctgctttctgcttctcccccaatgggagtttcctgagggagaggcattatggggaagaaggcagagtgtgaaaggaaggggatgaggggatagtcggggtgagggggttggaacagaagaggggtgagcacagaggcaatgacggggagaggaggagggggagagacacaaaccttccagctagggatctgagatgacgggaacatgccgggcccaatggtgtaataatgagcgtagtctggaaggtggacagaggtgacccgagggagcaggcgggaggcaggcaggcaatgagggaaaaggcctgcacccgtgggccccacgtgggactcacttgataaactatagtgagaaaacccgttagacaactggaaacaaacaaaaaaagggggggggaaggaaaaaaaattaatataacaggatgagtgcggagatacaaaatggcattgacattcaagggaggggaaacctgaatatttataaataaaacaaacattggggctctgctgctcacggatgatctgtgatgcaagagaaaagagccggggtgcaaagaatgcacatgagtttgacagcaaataagcatctatgtttgacctacgttttagaagtttggaaattgatcagtgccctcaatttgtggccttgtcaatggtttttgataatgtaactaatgaagcctcatttaatggtgatagtgatttgctcatttcattatgcaaatttaaaaattccaaagcatcttcaaatgaatctgttcattctaggtttccaaaatcatcgcattgctcaggagcacattctcaatcaagggcaggggggtgggggtgcaaactaaaaagcggaaaagcacacagcctctgacacagtgacatggctcatccaacggtctggtgggtggctcgggaagggagggaggaggatggacaggcacgcaacacctggtctgggagaaagccttcacacctccaaattccccataccccttcctctcccttgagacaaccatgtggtcattgtccagcagccaggcactcattctagaaaatgccctcagccttgtcccaccctctgtccccaagaggagccccactcttggtgtcgattctgagcttccaggttgccgcggctgtgagggctgtctgagcagcaggcagggggaccagggagagtggggccgctgtggctgccacccgggcggtcaccttctctgtggacacccaggcacccatggtggagcccgagctgacagaggtgggggagctgcactcgctcactgactggcaggtttccgaggcttcggaggaggccgagctggacgagttctgcagcaggggaggggccacacgaggggaccaacagaaaccgagccacacaccaccaaaatataataaataaaaaaaggaatggggatgggagtggggaagggcacacacagagagaaagagacagacatatacacagaagaggggaggatgagagaagcagagggttagggttacttttcccccaaagttgcatccatgcagaggctttcgagcccttgaaaagaagcgtgcgacccggccagccctaggtcactagactgtgggtccccaaggacacggatttgtgtgtcttttgctgggacccagaagcatgcctggcaccgaaatatctggtcatggcattgggacttcgtgctctcttgggtgtttcttcacgtgccacaggcccaggtccccagggaggccccgcctgtcacctctcttatgtgcataggtgttatttattgcatgagggcggaccccagctcgggcttttgctacatgtctgcctggaatggctcgacttcctggagtctcctttcatcaaatgcagcctgtggatccatgaggggtggtttccagctatgaagcctcatcaagacagacttttaggtttctcatcctggagtgtgattttggggtttggggcagtgaagccctctggtcagcacaatgtttctggtggccattgtggggtggaatgaaccatctctggagaggtctcatttgggaaaccatcgctttacactgatctgatggaaccccaggtccctgctggagtcctagtcagccacggcatgcgctcccagtctggcttcctgatgttcagctggggcagggactgttcctatgatctcacctacacccaagtttcttctagttctggacctggcacatggctggtgctcaaaacataatgaatgagtgacaatgatcatctctgtcacgtaagttgggtctcctgggcactgctttgcatccatccaggtacttgctttaaattttttcactgttaactgcaatctctggcttaacctcagtttgtttaaataagctgactcctctctattgtaatttatctgaaagtgttcctgtattcaccatcaaggaggccagaatcatatttctgtccctttcacctacaaaagaaaggtccctacaaaggaacagagatttcgctttcctgtcctgtaagggcaaggagacaatcagacactcaacaatgtgtggggctcagtggacccaaagcaaggagagactccacggtggacggacatcccagctgcactctgagctcagtgtctggttagcagcccaggatttgaagatggaaggtttggatttaagtcacatttgtgccaattcccagtcgagaaactgaacttaaaaaatttgaggtttagagggctttatcaacaaaaaacagccagatgtggtggctcatgcctgtaatcctggcactttgggaggccaaggcaggaagactgcttgaggctaggaattggagaacagcctgggcaagatagcaagacctcatctctacaaaaaataaaaaatgtaaaagaggaaaggagtgagggttgaaaaattgcctatcagagacaatgctcactatttgggtaatggaaatagaagcccaatcctcaccagtatgcaaggcacatgtattctcaaatctaaaataaaattagccaagcatggtggcacatgcctatagtcccagctacttggtaggctgaggtaggagaattgcctgaatccaggagttcaaggttacagtgacctatgatcccgccactgcacttcatcctgggcaacagagtgagaccctgtctcaaaaaaaacgaacaaaaataaaacaacaaaacagtaacccaccgcaggactgcaggttcagatttctttggaattatgctcattttttataaagaacctcttgactcagatggaataaatggctctagggtgagaccctcattgaagacatggccccactcctgggcacagatgggtgagggcacaatttgaagagtggagggaggtaaaccagagaattctgaacaaattccatcactcggctttcatctcagacctgtgttactcagtagagaaatgaagggctcctgcgcctcctagatgtatgccccctttctccctaataaaggggaggttactgccttcaggagattgtaccctctggctaatgtgatctgtacaatgaccttcaatttcccctttaccttataataataagcagtcgtaatgcctttcttaaaaaataagaattctctattaagttttgtagcatccctgagctcattaaaactaccctagtggccgggcgcggtggctcatgcctgtaattccagaattttgggagaccgaggtgggcggatcacctgaggtcagcctgaccagcctggcaaaagcccacctctactaaaaatacaaaagttagctgggaatggtggcgcgtgcctgtaatcccagctacttgggaggctgaggcaggagaatcgcttgaacccaggaggtggaggttacagtgagccaacattgcaccactgcactccagcctggggtgacaaagcgagactgtcttaaaaacataacatgacaaaacaaaaagctaccctagagttgctagccacgcatgtcttgggcacaggttttcagatttaagtaaacccaatatgccctcttctgcttccctccatgccatgggaaacactctgttctaccccatccacactcacagtcttggaagggaaggctgcagcacgtggcttctccttttcagaaaggggcgtcagtgcacactactatgttaatttgtcaattaaacacacacacacaattatgctgcacactagaacagcccggaggaactgcacattccagccctcctcccgaccctttgccctctctgcttgtgagcagcacatatggtttagtgaagcacacagcggggaagaggagctccttacagaccaagccaagcaccccaggtgggacacgcactctcaagcactctcaaactatagccgtggctcttggctctgagtgcgtttaaaattgagtgtgtatccaaggaaggcagacagaggccacagtccccaggatggctgaaaaatgctaatgggagcgctgagctgtgaggagaggaacgcagagctctgacatgggtttcccagcaggtggggctgtggggcacccagcattctgtatgtagagctacttgccaagttcaaggccgacaccaacccaatgacactaagggagagaggacagagagaggatcacatacattgatgatgcacatgaagagtgttcagatgccctggccagctcctgcgttctgctccagctggaaccactgggctgggctgggcctagcaccattaaacccagctgtagttgaagagattctgccacaccttcccttccagaatctaagtgccaacagaattatgtgcagaagctctgatgattcattctcattctcaacacagattgataaaaggaacctgagagcgccaagggatggtatcggaagcgctattcaaccatagaatctcagccattcagggagaacctgagatgtgggggaggaggtgtccccattgtgcaatgccctttaattatagcatttaattatgccaagctgggcacttacagggacgcctgagagtggtcaaacctctttcaatccatctacttacgtgagagctccccaaatcgatgtggtaatgcaaccattaccaccatggagacaggcttcaaacccacttatagcacctctccctttaggggaacaatacatctaaagatgagaaattaaaccagaggtttctcaagtcagtgggcaggggattgtctaagccaaggtgcttctttggttctggccactgacagtggtcaggacaccaggtgtgacagctgctcctggagccaagggcacccttacctggttgggggcctctggcggcatgggggatggtgacttggactggaaggcatcctgggatatgaatcctgagtcatgggaggacacgctggacagcctcacaggagcctgctgggccaggttggagctgcggtagcggtaatgtgagctgggggaatgcgagtgggagccgctggaccgggagtcactgctgttgacactgttcaggctgctgtggaggacaagcaggggtgaggggtgggcacggaaggtaaagaaaggggagcagtggtaagaggaaggaggaaggaggggaacagatgaggcagaagagagagaagcacaacataatgcaattagctctctgccctggagatgcagtgcaaaccacaaaacacgttttcaaaacaccaaatcatgaaggtagtcaacaaaatgcttttccaggtgacccagggggaaatacagctgccaggactcaggtctccgatggtaaccatgtggcattcttacgagggaggtctggggttctaaaacgtcaagtgcgcccaactctgctgcttcgcctaccaccaaaacgaggggagctgatgtcagtagcaagaaaagggacagggttaatctgcctgcaggaaccatgagcctgcagcaaaagtccactggggcttcagcatgactggaatgttcttggatggaccatctgggtccacatgaccaaggccaacccagctaagcactgccgatggatttgctgaggtgatttcatcctagctgagtctggtcaagcccgctgtcaagaacatcagcaaatcaactcactatgttggtgtgcatatgttttaccttttaacaaagtgatgctttaattaatgtttttactctgaccccagctgtttctgtgttaaaatatctgtgggtctggcacaatagcacacttggcaagaggcaggcagctttcagcgactaagggcaatcaatgctcagctgtttgctcttgaaatggcacagtaaacaggatgtcaaataatgacacacccgctctggatttctgtctgccttccatctccactcaaaagaaacatgctcctggccaggtgcggtggcttacgcctgtaatcccaacacttcagaaggccaaagcgggtggatcacctgaagtcaggagttcaagactagcctggccaatacggtgaaaccccgcctctgataaaaatacaaaacttagccaggcatggtggcaggcacctataatcgcagctacttgggaggccaaggcaggagaatcacttgaacccaggaggcagaagttgcagcgagctgagattatgccactgcactccacctggacaacagaacgagacccgatctcaaaaaaaaaaaaaaaaaaaaaatgctccacactctgtatagtaacttagatcataaaaagcagaaaacagactcccatggtccaaacaaacggagctgaaataaaaagagcagttgtagaggcagcagcagggatgaagtaaataactagggctgggataggaaaagtcatggtttctgctcctaagcctgcaagagactctggcttgcaaaatctggcagctaataaggtactcaagggccgcgtgactgttctacactagaattacttggtgcaaatgttcagacagacataggggagcgtgctggaggaaatcgctgcagtgaggaataaatatcatgatttttgactttcccctccagtcagccagaaggcggcagttggggaccgacagtaaagctcacagcaactccaccccggcagcctcagagttgcagatgtcagtgcaacatggttttctactcaaactaaaattataaggaagaaaaaaacagccacgcaactttgttttacactaatgagagatttttcttggcaacaataaaaaggtctctctttcactcacacacacacacacacacacacacacagtcgacagaagataagaaacaaaccaatatcttcagggggcagaatgtccaggatgcagcgtcttaggtctgaacttcctgctaagtgtgtagtgtacaagctccgcagtgaaaggaaataggcatcagcgtgcaccaaaacatcaccacagacagattgagcagatacatcctgccctctactctcagtgctaatacacaggaagtggaaactcatttggctttgaaagttaaattaaaagagtaacaggactactataccaagagagatagatggtacatcatgcttccatctttcaaggagaggaaaagaaactttcctactcggcaagccaagaactgacttctaacagaaaattgctagacaacagttttgcagatggcagaactattccaacagattttgttccaatagggaacagtactaattaatacaggtgtggtcgtggtagtggtggtagtagtagcagtgactgacagagcaagaactctatttactttatgaaaccctgaaacaaaaatatggggtgaaatgagggcataagccattgttacttccttcgtttgttctggcaacagtgagatcagcctgtgtaaaaatcaacccaggttcaccattttttaggccttagaaggttttcactctgctaaacaggaaaatcaaatgtgatctcatagaataggaaaatccctacaacatacaagtgagagagaataagctacatccacaagtcaagggctaatggggttttctttctgatccaaaattaatccagagactaaagagcaagaccaaaattattaccattctttcagctcatcatcccatttcctgtttgagaatgagccattctaagagataaggactggctccattgctcacattagcataaagaaaaatgacccgtcctgaaagcaagagtggaccccggcttcactcacctgcagacactggactttctggacatggtggtgctgggggaagagggtggcgtctgatacgaccagctgtaatcagaacctttcaagtccagaatcacctaaggggacagagccagctgggtgaatgaggtgctgagaggggaagcgttagccatcaaagcttaacatccaccaaagcatcaaaacgctgccatcgtgggggtgggaatgaaagcaaaacatgttaaaaaaattttttttaaattgaagagccacagtaccaaatccatcaatatcataatccttttactgagaaagtaaaactataattaatagggagaaggaaaggaagggaaaaggaaaatcatgaaatatcagtcgagagagggagaaatacagtgaccaattaataatttataacagccatttatacccaaggctagaatttacaggattttcctcttgtaatgccataaagttaatcatggttcccagacttgttggtagcgcattttaaccacttgatattcagtggtcatttctgccctatttgaccagcactagaaattttaaagcctgacagaatcaagaacaagccaattctttcaccattatttctatatctgtctccgttgcttgacaaaggaccacatgagtataaggtccacctttcattcacataagaagcactcagtaaatgtttatttgtcaagtgaatgcatgcatgctctggtctaataaatataatttgatagaatagaaaacatgagctcccaaatttgccctctgagccagctctccaaggagacgaaaagattgttaccaagcacaaaagccagcatgtgattcatcagttcccccaaatatgtctcttcccatagtgtgcgtgtgatgtgaattaaatgaataaagcataaaaatgtcatctttttcataagatgagagagctctccatgcattgctcaattagaatgggagaaatggagaatggttgacagtgtcaatcaaaacacaccagcgacgtgttcttaggagggttgacttctagagggcagatgaacacagcaattaagtgcatgggatctggaacctgaccaacttggttcaaatatcagttccactacctgctagctagctgaacctggctaagtgactccatctctcagtgcctctgcatcattctctataaaacaagcataatcatgaagatgaatggaggaagtcaggctatgtaaagagcttgggacagtgcctgacacacaataggttctatgtaacagctcgctgtggtgatttcatatattacatcatgaaggacgtggtgaatatgactacaatttaagacgtgacacatgccacaggaacactcagggccttgagcttttacctctttggtttgatcctgtaagtgcttaacccctgaagcctacctgttcacttgaggagggcagtttgtgagggtccatggtcaggctttttagatcttccgagatggtctgaaggtgggttatttcccctagcattgagatttcttcttcctgaaggaaaagtcattcatgaaatgttattatcatgagtgattcccttcatcgctctagtccaattgttttcattagggtctctgtataaccctttcagtttttcagaaaaggcactgttgggactggcaaatctttgctgaaggcactacatgccttttcttttgggaaatgagatggaaaaagaaatctgccataatggaggagtgacctgtgcacaggggacagtggggaacacacaggcctccctcccagggcctgggggactgccaggcctgctcagatggtctgactgtgtgttcccacgggatcctgcagcacagccctcttcatactgtggcccttttctgaagttgcttagcttcaatggatgacacgacttggatatattttggtccagatctttgtgacagtgcctgtgtgttcaacagaagctaacttttccccttctttcttgtgcttttccagcaacttagtaaaagacaagtaagacaggagctggggaccatggaagaaacatcccatgtgctttatcgaagtgccaagttgggaccacgggccgggctagaacgatccatggaaaagttctgtgctcaggggaacaactcaaattcagacattttgctagggctaagggaaatgagctggtaccttcgaatcagcttccagaacgcctgcagtgcaagttctcaattacggcatgcaaatgatttccttaaaaattaagtctaaattgattcattgaggctcttggatattcatctcatggtcaccccttagtactcggctacaacagtgagtctcaaaaccacctggagtgctcctttaaaacacagacgactgggtccccacccccagaggtttggacttggtgggtctgggttgggcccaagaacttgcatttctagccagttcccacgtgatgctgctgacctggggacctcactttgagaaccaccctgctgggccttcttgacttggtgagacaaagtaacggggaacaagtggtactagaacagtgaatgaggagtgagctacatggccatcaacttgcactgaatcgctggtctgtacaggagataccaccatcatgattcctgacagtagattctccatgactcaacagtggatggataaaattagaaggaagccacctctacaccagcagtttaaaccttctggagttttccattaacttacaatcactggccgcagcatagagatgaaggtacagaatcggccacgttcttcaatcaaagccttccggacagcctgcttttctgtttcttccaataagagatacttatcattgacatcttggagagcactgtccaactgaggctggatatcacctctccctgcaaaaaacagagacccaagcacggcttgctgaaataccagcttctggaacaagtgcccctcctccctggggtccttgctggagtcaaaaccacaattttccaggatgtaaaaaaagtatttattcatgccccaaaaggatttaaggcagctgtttttctaggaccagccatttccaattttcaatgcccaaagggcacatttagcctggcttattcctgacaaggaaaatgtcctggggcaactcttcatgacttgccttctcacactgcacaacccccaccaactcttctgccaacacaaccctggaacacagagccagacagcattctttccttgcagaacattctgaagaggctaagagatgtggaaacaaggtaagagcctgtgggtgtttccaaaaacgggcacgggctggctttgttgggtcaatctcaatcaaagagcctctgtctggatagaaggatctgctcctaaagacaaaggtggcaagcatccgctctcctggctctgggggcccatgggaatccttggcagttcctttgactctctagtggagagtcttgaatgctcttgctgtagaacaagcccagtaataacaagacctccagacaggtctctgatgatgaaaaactgaaagtggggtctatgcggagcctggcccatgtttaggaattatctggccaggtccacagaccccagttaggtgcaggcaaccacttctggagtttaagacagggtgttagtcttttgaatgactaacacatggtcagcaaaccatctttgcaaataaagttttattagaacacagccaaatccatttatttaccatattgcctgtaccagttctccctacaatggcagagtagtgtgacacagagtatggcccccagaccatggcctcttgcaaaagaagcctgctgccctaaaagataaacatggaccaagaggcactgtgtccaaaggagcagctactacaaatctgatctgtaggtggggacagcagggtgacagcaggggacaccagctcatgagcttccaccttgggctgcctatgcaggggccttacctatcactcaaaccagagagatacttcctaaacttcttcagggcaggattttggtctttcccagcacagcccctagtacaatgtcatgtgtgtatacagcaggtgcttgataaatgtctgtttaatagtttcaacacaaaatgttagagctggaaggggttatccaattgggccaatctgctcatgtttcaatggagaccaagtcctagagaagtcaagggactcacctaaggtcacagaaagaatggtacagaggcagggttgagccacactgcctaattcccttaacactgaacctattctctgccccaccgcctcgcaggaagggccctgcagtttccatctatccctcttagtgatgtagagaacattaaatgcaatgaaccatttggtctgaagaaagaaagggtcagggaaaattgccttggatgtaggaacatattctgtatttttcactcataagcagaggagaaagtttaatttggagcaagaggcaatcaggcttaaagcacatcccaatagaaaaggtagtcagattttagtaaggaaaagtcacttctcagacagggaataagttctaagttagcacattatgagaaaattatagtcaaagatcacccttgaaaatgccttagatggccagtaaatacagtatggacagctttgtgtatataactctcatcagtcaagtgagtacaaatgtgtagatagtatgtatctaagtccacggaggggtgctacccaacgattatactacactggcccctcctctgtggttttgctttccaaagtttcagctacccatggtgtggtaaaatacggtattttgaaagagagaaagagactacattcgcatgacttttattacagtatattgttataattgttctattattattgttgttaatctcttactgtgcctaaattatgtattaaactttaccatagacatgtatgcatgggaaaaaccacagtatatgtaaggttcgggtactatctgcagttttaggcatccacggggggtcttggaacatatcccctgaggagaagggggaactactatatataagaaatttgctgcttgagaagtctctgcataattttctcctttttggagacagagtcttgctctgtcactcaggctggagtgcagtggaatgatcatagctcattgcagcctcagcctcttaagcagctgggactaccagcgtgcaccaccatgcccagctagtttttcaatttttttttataaagattgggtcttgctttattggccagacggtcttgaactcctggcctcaagtgatcctcccacctcagcctcccaaagtgctgggattacagacatgagccacagcgcctgggtgtttcagcatattttcaaggtgacccactcacccattcttccatgtagtcactacctccacccctcagaataattctttaccatgccttcaatttcttcctcaaggatgtaggagtaatcatcaccatacattaatctggccacctgagccactggtttcatgtgtttttagtagacaagaaacctgtaaaaacattctcccattctctcctggaatctgcctcagggcaggtgctctgttcacagagacccaccacctgtggccaacggcttacagagggaaggctgggtgccaccagcactatgaaaactgtgagttttctcttctattttaaaatgctggctagtgcaaaattaatccagatatacttaatgtgtgtatgatacgagtccaccagcagggaagctctggaaagctgtaaacccttgcttttcctctgcaagcagccaaacagcatggccaattgtgggccttgttgggtcacatgactcagggctggtctagagggctacttctagtctctcgatctattctatgatgttctaataacaaaacacagagggctgcagaccacctcagaatgttctcaactctcgtgtaggatggtgaacagaagtcgggagacaccagattgagacacattgtgtttgaccaaacttgctcggtgggctttgattatggtagcaatttaaaaaaataacagcctatgaggccgggaacggtggctcatgcttctaatcccagcactttgggaggccgcggcgggcggatcatgaggtcaggagttcaagaccagcctggccaatatggtgaaaccccgtctctactaaaagtacaaaaattagctgggtgtggtggcacacgcctgtagtcccagccactggggaggctgaggcagaagaattgcttgaacctgggagggggaggttgcagtgagctgagatcatgccactgcactccagcctgggcgacagagcaagactccatctaaaataaataaatagataaaataaaattaaaaaataacagcctgtgattgtcagaaattggaaaaatgtatctttacttcctttcacaagttataaggcacatgtctatccataattaataatgctgactttaaaaactgtatctacataggaaagaaaaaaaggccactgaacccagtgttatctaatttggaaaatataaatttaagttatcctatgattatagcaaagttattttaaatgtgtattataattaaaggactctcaaattgtagcattctaaaataagtatactctgtaaagattgctataattatagtcaagacatttccattcaggatagatgataagctaaaactacaatgtttatttattaaattcactaatacaacatgtaattatatttataaaaaaaaactgtgaaagaaattatttcatgtcccagttggatatactggttttaagatagagtgatcttttgaggtccacaaattcagagagttgtgttggtactgatttaatatatacaaaagcccattctcttcactcccatcggcagtgttaggagagtcaccactgactccttgagcgctggtcctggctattccagctcccacggacttgactccatcctcgtctcacctctgctacctctaccctcactgggccatcacgatctctcacctgaacagatgccaacagcccctaatgtctcaccccagactgcacttggactagctcgcccagagcagccctgggctactttctttcttttcttttctttttttttttttttttgagacagagtctcgctctgttgcccaggctggatggagtgcagtggcgtgatctcagctcactgcaacctccgcctgccaggttcaagagattctcttgccttagccacccaagtagctgggattacaggcatgtaccaccatgcccagctaatttttgtatttttagtagagacaggatttcaccatgttggccaggctggtcttgaacccctgacctcaagtgatccacctgcctcggcctcccaaagtgctgggattacaggcatgagccaccacacccggctgtggattactttcaaaatgcaaatattctcactgcttttcaacagctcccattgctcgcaagaaaagaacaatatccttaacatggcctgccctgcaaggcatgaaaggtcattgcctgtctacctcatagcctcagcctttgtgggccattctctccctctctcctctccctctcatcctccagggcctgggccccttcccatcttcactctgctgtccctctgctacattcctaacaccttttatcctacaggtctcgcttaattctcgatccttcagggaatcctgctgtgaactttctccccagattaggcttctcttacttgatctctgaaatcccttatacttattcacagcactacccccggtttgaatttcatctttatttctctagttatttgattgacgtcagtctcccctagtcagggggcagtcccacgggggcagaacccatgaatgcttttgctcagtactgtatctcctcagtcagcacacttgcctggaaggcggcaggtgttcaaatatttgtaaatgaatcaagcattgatacaacgtgaccaagtttgctcactggcctcaaccatcattcccttaaatggcctaatacttcagaaccacccaattccaggaccatcaagcagccaagaggaggagggagggggtgccttcgatgggcttcccagacaaaattcttgagcaaagaattgctttcggctttcttctgtaatatcttaggcatcttcagtcttgagttttgtttttttcctggtgctagtttccaggtcttgtgtattcacgctggggaattctgatgaacagcagccaggagccccttatccccccaccccaggggatatcatgatgattctctttgcagaaaatgttcctggggcaaagcattgtgaatgcaccatgtcatgggccaaggcagcacccctaaagaaggaaggaatttttttttttgagacagagtctcgctctgttgcctaggctggagtgcagcggcacaatctcagctcactgaaacctctgcctcctgggttcaagacagtatgtccgactaatttttgtattttttgtagagacagggttttactatgttggccaggctggtctcgaactcctgaccttaagtgatctgcctgcctcggcctcccaaactgctgggatcacagtgtgagccaccacacccggccacagaaggaaggaatttttaaatgaggaaactttacagagttttctggaatgaaataaagatcctgtatcaacttcaacacttgcattttattttccttaatcattattacataacacattcaaggcaggaatgaatatccgttttgatagatggggaaactgagactgagggaggcaaagtggtctgcacagggccacaatcatgagcactaagccagccacgggcacagctagaatccagccccaagtctttctcgttctgaagacgaggttctttgtgtttcctactcacagcaaacatgaatgctgggaacaagctgccaggagctaaacagccgatcaaaaagccagtgaaatgtgattcgtattatctgtactggcccagcctcttcagacacaagctgcactcacatggtaagcttcctggctcaacaagccagtggctgttctctggcaaagggctctccaacggggaagagcaaacccagaatacattgggccaagaatgctgccaggagtcagcaaaacaccccaagtcctttctttcttcggagagaggtgtatggagaagccattagaatcctgcaaaatgactttcacctgcccctgactcacacaaattcattctaagatatttcattctaagagagccactttcccccatttttacacctcaccaatcagggtgtgtcttacaatcaatggtgtgtcacagtttaatcggtaggttttttttttcctttcttagtggtctggaaaataatggtgcatctgacaattgcttgtatcccagagtcaaatgaaacatgggatataaatactaaaatacaaaatataaatccagaaatggacatgcaaggtgacactggagattagaatttggaatgaaaaattctgtcttcccagcaaaaggaggctatcctcattatccctttataagtcatcttctactcttaataacccacagtgggttttgactgattcccaaaagaaaaatccaacccgaaatcaaaagatagatgtgattagataagactgaaggcttttagccttaaaatttttcaaacaaactcaatttccgttatttttcaacctactgtgccccagtttccctttacctgtgggatgtaaataataacagtattgagctcacagggctgctggaaggggaaatgaactaatccacatgaagcattcagaacaacgcccggcacgtgctgagcactcactaaatgtcaggcactatcagctgccaccacagcatctctgaagttgtccttctgacactgggtagtttagcaggtgatagtatgcagggtagggtgggttttttgttgttgttgtttgtttgtttgttttttaaagagagctttcagttcaaggtcgtttttgatgtaagaaaatgcaaaagatcccatgattctttcactacaagtaggagttttatcatcaagattcttcactggtccctgggcaatcagttgtttatcaaagcaaaggataaaaagagacatttcagagaacaactagaaaacgtcccaggccaacctgcagctcaccatccagagtgtctccaacagagcatcctcacggctccaaaatgcttcttccttggtggttaaagaaatactccaccatctgccaacctgactaccggatccagaaatttaccattgccttcaactcttccttctttcatttgcatttctcctaagtagctcttgaatccacctgtcttcctctctatctctgtggtcacttccctgagcccaggccaccatcatctgtcacctagacaacaaccaccacttgctaactggatgtccagttaagccacagtctaatccaaatacacactgtcacggtggaattatctagaagccaaaaaggcttcaagggcttcagcagagtcctttaatgtagtaaacaaggctacaatctgcattctttataagaagccagtcattgtaaatatggtgctttcctgtgttctgcaagtccttctagagaattattaaacttgatgggcgagggggtcatagaaaaccccaaatttgtggtcggctgggcagaagtgtgaggaatctgaggaccccacttgtggctggtgactgaatttggggcagtctcatgggactgaactcttagcttgtggggtctacactaacactaggtgtgtcataactgaataggacagcagctgcagtcagagaattgatgttggaacataaatgcattcttcgtgctggggagagcttgagtgtagatgctacttttacctccttagcagctaacagagtctagcacagaggaggcttgtcatacccctttcctgaatgaatgaatgaaagaacaaactaataaatggaggctggagtgttttgcaggactcatctgcagcagtcaaggatgtttatgaatggaagaatggcaccaggcgtgaatcaattagtcctacaaaaaccataaatggctgatgggttgcaactcaagagaggcagcaactgcttccccaccctgccattccgtcaggctttgcccatcccgttagtgttctctagggagatgaaaaccatattatgcaaggaataaatatttcaagcaagttgtctgtttccttctctgctgttttgtatttggtcgaaaattaacgctaagaaaaatactcagctcccggcgtgcctccatactctatatacctctaccctgcccctgaatgcagccacagggaagtcaggtgcactgcaccttaacagtcctattgtgtacaggcacacccagggcattctgagaccagagtagtgggcaaggcactcaaggagttgtgtctacgtgaggttttactggagacaagctttgcaaaggaagagttcacagctctaggcttctggtggatctgtttggcttgtgtttacctagaatcctcagttataaaatacatctaataaatagcccggcctctgaaggctacatacattcacctgaaatgcaacatccctttgcagtaaatttcttttattttggagacagggtctcactctgtcacccagactggagtgcagtggagcgatctcggctcactgcaacctctgcctcccaggtttaagcgattcttctgcctcagcatcccaagtcgctgagaatgcaggtgcacgccaccacacccagctaacttttgtatttttagtagagatagggttttgccatgatggccaggctggtctcagactcatgacctcaagtgatcctcccaaagtgctgggattacaggcatgagccactgtgcccggccttggaggagatttctgagttaaattcagacatctatggattcaggtcaggggcagctttctgatggtcacaataggtctaagggtaaaattctagcatccctgcttccacccagacagaaggggtctggctgtgcctacattctgtatttcctcatcagccttctaagccctgggcttagcctcgaagaactggctggaaccatcccaccctctgctccttgttcttcctcctcactccactgacatccctgtgggaaggagagctcctagtactatccctcctcaaaaatcaatgggggtggggttgcagggaatctacacagattcaatttttaccatagaggcagagccattgatccattgactgcaggtctcagggtcattctgagagtgctttctgctggttttgtaaacacaagaaacattcctgtgggtgagtgcataggctggatacggctgggggatgagcaaaccactgtgcctagaggaaaggattcacatttcacaggctttttccaagaaaggaagaatgacgtggagaggcatttggggtccactttggagtctgatcagaatcgaggcccagtgattgaaccattctggaggcaggtcagtgtggggtggggagacgcggtccaggaagccagaggctgagtagccaggggtcactatggttctctatgcacacagtccacccttggtgggacgacagccctgcctcaaggctgtccctggagcatcacacacacagtgtgacacgtctacccttcaccactgttgctgatgctcctttctaaatgacaagagccatgtgttggtgcacgctgtcctctccaccttgaatatcccctcctcattcttcaacagctgacccctcatgctcctcctcattatcactaccctacccccaggcttagtgaggctccttcctctctgcccccaggttacaccttttgcttatattcatcccagcactggctggcagggtggctcacacctgtaatcccagcactttgggaggccaaggcaacaggatcacccgaggtcaggagttcaagaccatcctgcctaacatggcaaaaccccgtctctactaaaaatagaaaaatttgccgggtgtggtggcaggcacttgtaatcccagctacttgggaggctgaggctggagaattgcttgaacccaggagacggaggttgcagtgagccgagatcgtgtcactgatcgtgatggggttttaccatgttggccaggctggtctcgaactcctgacttcaggtgatctgcccacctaggcctcccaaagtgctgggattacaggcatgagccaccacgccaacgcgcccagccaagccaactgttaaaaataattaaagaattatttttttctctctgtataaatattttaaacatttatgagagctacaaatcatatagcttttcttgtgtatttatacccaaattcactgtggctttgcctatgaaccagcccctacaagagaaaaaattaaagggggttgcagagatttctctttgaaagataagcagaatctttagaacttacaaagtcaaaaggctatacagtttctttattcattccaaactgacctcccatcatttcaaataaataaaatgctctatttactccatgaactgactcatgtcaggctctcggcaaaggttccagtaaaactcaagactcaagggactgtgtcctcaaaaggctgtgtactacatgattccatttgtataaaatgtccagaataggcaaatccagagacagaaggcagatgagtggttgtcagggtcagcgtgggtggggagactgtgaaacagggagggactgcttaatgggcatgaggtgtctttcggggataatgaaaatgttgtgaaattagatagtggcgatggttgcataacaccatgaatgtactaaaagccactgaaacttatacttcagaacggctaaaatgataaattctgtgatgtgaattttactgcaataagcaaaacagtgactgtgtcttaccttccttccaaaggtttactagaaactgtgcaagctgtttcataatcacaatgttgagaactggaaaggatgatcctttttaaagttggggaaccactagcccaacatcgccatgaggggaaatagaggccgtgtcagccccaaccatcaaaggagacctttgtgcactgggtttgctgtaaatgacagaagccacttcaaaagcctctttggagctgttcagtaaaatgctcagggaacacctgggcacactcaggcaagataaaccacacagacacctcgcagacagacctcccaggacagagggacagcaacaagactccaaaagcaacttgaagttttggcagcatgatcatccacagagtgaagttcaacattcagtcaagaagaatcattctgattacttaattggaagatctgatacttctgaaatgaaacatttcacaaactctactgaaataagaaatacttttgatttattttttaaaaaatgaatcattggttatggaaagaactatatggtcttgcagacaggacaaagttaaagatgttttgcaagcttaacacaaccaaatctgatttgagaattattttgaggcttgcagctctgtttgtggcataaatatatacatacatacatacgcaggtatatatgtatgcaaaaatgcttattgactgtggaaatgacagtttaagtcactctgtatttcttttttccatgagtctaatattgaattacgatgattcaaaggctctcagagtgttgtgctaacatcgtaaatggctaaacatccaaaaaagaaaacaattaaaacacaacgcacacacaattttcttaaagttgtggaaaattaggtaggcacagttgattgttttgagctggtagaaaaacctgggcagctagcagaggtctggacaaccacggaaagcccacagcaaggaccacaccgtgagcagccaccagagatttgggatggtagacttaccaagagtgtccactggcgggggggcacacggtgagaaagtgcaggatacacaattgacacaaaaaggaaaataataaagtcaaactggtattcaagcagcagcagtcttacctttgtttcatgtgttaaacagtccatggctcgccaccaaattttctattagggctgattaaacccacatccacattccccttctctgccttactaatatcttccttccttctcatctaaacaaaaccttcccagttagtaatgaccacccctagagaagacagcaaggatttttaaaaagagagatgaagaatatatacccagaagaagccaagctttggcaagaaaacctttcgagtgtcatttaccatcacttgaaaaatatctaggaaattcctaggaaacaaagcttagggtgggatgaaaatggaaaaaaaaaattaaagagtttaaaattgtagtataacagcaaatactatgctcgtatagaactctgtgagtctgtttattacatttataacattggctttgcagcctctagtggaaagtgagagagtcaactatttacatgtcagctgtgcagttaacatattataatgttccagttctctctctctcaagaaaagtccctgctgggcgcagtggtgtgtgcctgtaatcccagctactagggaggctgaggcgggaagatccctgaagcccaggagtttgaggtcagcctaggccacctagtgagatgctgactcaaaaaaaaaaaaaaaaaaaatcaagacttcttagatttaatgatgtcatggtaataagtggaacagtgaccataataagtacctaatgaatgctggccattattatttttaaaaatcccttataaactttttgtagttacagatggaaacagaaggctttaccagaatttttttatttttttttttgagacagagtctccctccgttgcccaggctggagtgcagtggtgcaatcttggctcattgcaacctccaccttccaggttcaagcaattctcctgcctcagcctcccgagtagctgggactacaggcgcccgccaccacgcccggctaatttttgtatttttagtagagatggggtttcaccatgttggccaggatggtctcgatttcttgacctcatgatgcacccgcctcagcctcccaaagagctgggattacaggcgtgagccaccacgcacagcccagaattaatttttaattcacattgatagtaacatgggagttaaatgagaataaggctgctgagttcatacggttgggtggcacacgtaggtaaatacaatgtaaaacgcctctcatttctgatgctctctcttacttttccccattgggtcgtggtcaactccaagacctccaaggcaataagctgattatcatggagcaggaagagggctcaagagacactgttcagagcctggggttactgggtccgctccacaccatctccccagcatcctgccgcctccgtccctccacctgtcggcaatgctggctctgccccgtgctcttgaccctgtgcacgagcccagaatttctctgagggtgaggactggctaactccttgcctcgtgtttacttctagtaggcatctgacaagcttgccttcaagaaaaacaggcacactcatccacagccatagcatatcccaagctgctaaaaaatgattttgagataaaacctaccaaaggcaaaccattgaaagtttcttgaaggaaatatttaaacacctttagattacaaaccacctctctatatagtaagaaagagtcgaagaatgtgataaaaggtggtatctgcagagtaagaaggaaagtgagccgctcacaaaaatcacatccgtgtgtgtctgcccacgtcaaggatggtggtaaaaccatgcttacatgcacaaaggcacttgaaatgctaaaaggagagtccagagaatttttagatcaaagatcagagtttttgaaaaaggcatggcaggaagctgcttgagaatctcctggaaacatattaaaaaggaagtgattatctggctgcatacatcagattccgtctatcaggacaaaaaaaaaaatgtatccaaaaccttcatccatccgaacgcgtggtgcgtcagaaggaactgctaacacttttacaaaccgagggtccgggaatctgccacttgaaggagatgaaacagatccctcgaggtgttctagtagaaagggaaatgtcagctaaccagacccctaaacaactgaaagcctcaaatgaccagatttcttccagcccttaagtgagttgtgttttcttcagtccattctcagccatacatatgcctcctaggagagctctccataaaagattccagtccgaatgtgactctagtacctttcagaaggctgctttcatcccagaaatatacaaatagaacacctggtccaaaactgcacttactgattttagaaaaaaatctttataaaggacagaaataaaaattattttctggtggtatcttgaagtaactagaaattctctagaacattccaagctatggatctgaccgatctcgtggacctaagtccaccgtgtggaaaagacacggtgccagagactgctggtgtgaggctgtggctgagaagacagatgcttcagaaacccctgatcccaacctccattctctcatctgtcaggccaatgtgccctaagaaaccacacaactgaatgccaatcattcccaagtcccagggccagatgcctctcttcatgttatgcacagtccagcattctatgggtcccatatcttcctatccagccttgatagggagctcattatcctgcaggcagcccgagccagtgctaggaaggtctaattgccagaaacttcttttgatgttgcattgcaatcaccctatcaggcttcacccagaggtataaattctgctaattgggcaatgccagtgactttgagtgacagaggacaaccaattcagcctccatgcagaacttagataaaaggattatcactgtagccaagaacttagggcctctgaaaactgagtggtggaagagctgagggaaaacagccactttttcttccttcatccttttcaccaaactcccaaaccttttctaagcctaagcatcttccctggaccacctctcccagcccaggaatccttcctctctcaaagctgccaacctgtcagttatgtggagttcagccccgaactgtgaccagcctgctctcttccgggcctcagacttcatggaatatggtagtaattttacttataaatgcttacctctacagtcactaaaatgttactatgtcacaaaccctattacttgtcaaacactagctcccaggtgccctggttagataggatacaaatctgagaagctccagactaaaataaaacatacgaaagaaactgctggggccaatgctgatggaaaatctgattgtgggtgaaaattctgctgcctttatctcaaaatgggtttatggttgttgtgaaaattcagggtggggggctcattttatagaaatgttcaaggttaaaaactgtgtcctatcatcaccccactacacaccaccctccacaatcccatctctacaaatgtgtcttctatttccaacagagaacgctggtttaggggagagaaaattcaggctgggggatcccaactcgaaaaggttgtctcaaattaatggtaaacaccacccacagagcagcctgacggaagaatcccatcttatcagttgtgaagcagcagattcagaaacttggtgtcaaagaagaatagactggaaggaatgtcaccttctctagctcaggagaaagtccctacatttttaggtggtagtaaaatgtcacaagtgcttgcaaagtggatgctgctagatttttctcttcaaactcccagtccattctggaggaacaaaggtgggtcaaagatctgacgattcatttgtttgtgaaggaggataaacaaggatgtgggggaaaggcatcttgcctggttgtgctcagtggtagattatcaagctcctccctcatgaacaccatggaaaatcccctgtatggccatgactcccagcttcccctgcacccattcctagcattctcacaagacttaataaagggttttgaagattataggctgtgaaagctgcaggagaaaatgacataatttctgtaataattactagagaacatttgcataaaggcctttctgcattatcccaaggcttctaagaaatttataggtatcattacgaagcacaataggcatggaaactgtcaaacttggaagacaaaggtgggggaaggaacacgtcaagtaccacttggcaaaggcctcaaattaatacctattctgcactttgagaatgtgaactcagataggtcctatttgctcccacctgttttccagggccgtcatacttaaggaagtctctgaagtgaacacctttcacttcaaaaacaaatcaagtactccatcaggaagtaacatcagtggcagaattttaggagttacctttttttgctttcttctgcagtttcagcgtatccgaggacttcttttttatctcttggcgggctttcttatattctaagagaaagcagaatatggaacaattttaccactttgcttaacagaaaatatgttaggtaggaaacagccattacatttatcacagaaagcataaactgtgacatgccgtcaatggctttatcagaatacaatatgataatctcatgatgacatttacaacaaaggggctagagacacgaaaacaaaatgcacagtggtcttgccctgtcatattcactcataccagctttgaagggaggctccgtttgggaatactttttttttttttaagacagagtcttgttctgtggcccaggctggagtgcagtggcatgatctcggctcactgccacctccacctcccgagttcaagcgattctcccacctcagcctcctgagtagctgggattacaggcgcccaccaccacgcccagctaatttttgtacttttagtagagatggggtttcaccatgttggccaggctggtcttgaactcctgacctcaagtgatccttggcttcccaaagtgctgggattacaggcatgagccaccatgcctggcggggaatactttagtaaaaatgaaaaaaattcacaatttctcagctcaagtatccggaaagatttttcaatattatctactttccccgggcccaaatccacagtgttttgcaaaaacaaaaaaacaaacaaaaaacaaaaaacccctatgtggaaaagatgctgggcagatgttaaaatccagaaaaagtgtctcatacagcaggagaagctagatcacacagtggggagactgggcaagaagaaccagctgccttactttcagcatgaatcctgtggctagataccacaaacacctcagaggggcagtccaagtgcaccacatcccctgccaagcacttcctcctccaccactggcccattcgcagactgccccatttctgttgctggcatcctcatcacccagacatagacacctgggatgatggtcacctgtgacacttttccctttgctgccctcacagtcaattaattgccagctgctgtacatttcaccttggccagctcccttgcagccagctctgaggtttcccttctactggccctaagcctatttatacacacctggaatcactgtgcagcgtggcagctctccactcttttctggccactcccccatcttccctgcctatctgcacagttttctatctggctagggccccttcactgctctaacgtcagcgtgatgaaaccatgtacacctactgggatccctccaaatggtgcctcattttctaattcctcaaccaaacctctccaacctctggggctccctgtatctctctcccccaacatcctgtgctctgccctacagtctctcctccctccccctacaagctccccaggggacgcagcagtgcctgggtcatgtctgagcatcttgggctagcagagtgggttgcgtgtggctgctactcgggtcgcgctccctgagttaaaggctgaatcgaaaagatgaaggaagtgctgtgtcaccgaggctgggggttaggagctttgtaccccacaacctcttggcccctgtgcagacaggccacttagcaggtatgcaggccggacaatgggtctcaattcacattcaggcctaggctcttcatctctgtatgtgaccccaaagaagaaaattgagacgtgcttctctgtatgcagtgggaatgggaaggagggggaaatattccaagaaaatcaaggaacctgtgttttattggatgagtagacctctctgcaagacctgctgccttctcctaatgggctcagcacaactactcttataaaaggccttacacatcctatttgaagtctcagctttgctgtaccagcaaaggggaacatttaacagagtagaaggaggctcctgcagggtggtggggcccaaaaggcctcagaagtctgcaccggctcctcacacagacagagggtgaggagagacctgcgcaggagagcaggttccctgagggcaggggcctggccggatggttgtctatgcatccccagggcctcaacgagtccctggcatgcagcagatgcctgacaaatactcagccaatgaatgagccaagtcagccaacacaaagtgaattgggccaaacataaactatcaactctttccccatctgaaaaaaaatgtcaaatggttctattttcttttacccaatgaaaagtacagatggataaatcccgtgagcctaagaaaattcatgatgtgattaacacacaatgggatccagttaatcctctgaatttgcctctctccctaacttcaagttagggtaggggggataaaagattatatattaactattttttttcttgagatggagtcttgctgtgttgtccaggctggagtgcaacagtgcaatctcagctcaccgcagcctccgcctcctgagttcaagtgattcttgtgtctcagcctcccgagtagctgggattacaggcgcatgccaccacgcccagctaattggtttttttgtatttttagtggaggtggggttttgccatgttggccaggctggtcttgaactcctgacctcaagtgatccacccgcctcggcctcccaaaatgctgggattacaggcatgagccaccacgcctggcctatattaacttttttaatataactgctaagtatttggctattgtacccatacttctgaatctcaacacaaataagccatcaccctccctggttcttttatcaaaatggtttgttgaagttctacataagactgatttccaataacaatgaagacacgacttcaggagtctgttgtctgtgatagacaaagttaaaggacgtgcaccaaaaaccaagaccaacttatttatttctgtggctccagagcatgcacgggcatgaaatacggtaagtactcagtagcataggtgcatgatgaggggaggggtgaataatttgaatgaaccggcaactttctggtggctactgatagttgctggggacatagaatgattttcatgatatagcttgaagcaggcagaataaaccatccccatagtcacaaagaggcctgttttaggagccaccattcacactcccagagcacccggttgggtcttcattgcagtcttctactttgctttgtaacagggttaatttatttctgtttcagtagataccacactcatccttctgtagcccccatagcgcctagcatgtaaaaagcatcagaatgacctgaacaggggatgagaagctcttacgaaggtctggttggcctgtgtgaagggaacacaaacactctcactcgaaagcatcagtgctatttgctgtgcagattacacttagttcctctcataccatcaaggtccctgacaactcactcaaccagttcacaaagacttgtctcaccgacctgggacaacgcacaaagagaatgggcaggagacctagggtaagcttatatcattaaaagtctggctttcaaaatgtgctgaaatgccttaagtataaatgtttggcatttaaacctgccatgatgattttcacttctttggagggttagggggaggcagtgtcttgctctgtcacccaggctggagtgcagtggtgcaatctctgcttactgcaacctctgcctcctgggttcaaacaattctcgtgtctcagcctcccgagtagttgggattacaggcatgcaccaccacacctggatactttttgtatttttagtagccatagggtttcaccaagttggccaggctggtctcagactcctggactcaagtgatctgcccacctgagcctcctgaagtgctggaattacaggtgtgagccactgcacccggcctatgatttcttctttttctttttttttgttttttgagatggagtctcactctgtcgtccaggctggagtacaatggtgcaatcttggctcactgcaacctctgactcccgggttcaagcgatttttgtgtctcagcctcccaagtagctgggattacaggcacccaccaccatgcttggctaatttttgtgtttttagtagagatggggtttcaacatgttggccaggctggtctcaaactcctgacctcaagtgatccgcccgcctcggcctcccaaagtgccgggattacaggtctgagccaccgcgcccaccctgtgatttattcttaattcagctgaatacaattcatgccactgagggatcagactatcagctgctgaatgttgtttcacaccaaagaaacagcactcagcctcacaacgggatcactttgttctcctcatcccctgacacggacgtgcctacaggagagtagggacagagtgggcccttggctgttttggtgacaccaataaacctagcagaggggccaggcagcagctggcaacttcccacagcgccccccagcgtgcagtgatgcgctagacatctcgcccctgtaccttttgcgtggtctttatccagctggttggccactttcttccattcttccatctgttcttgaagtgggtttatcagacaatcaattaaagcgcttttaccaagcgggggggaaaaagggagaaattaaatagatacattctgttgtcaggatttaaatgtggttgtcaaaacatacctaaatcacaattacccgaaacgttctcatctaaaccccggggctccagaacagccatgttccaagaatgcttttcttttaagacagagtctcgctctgtcaccaggctggagtgcagtggcgcgatctcggctcactgcaaccaccacctcccaggttcaagcgattcccctgcctcagcctcccaggtagctgggactacaggaacacatcaccatgcccaactaattttttgtattttagtagagatgggttttcaccatgttggccaggatggtcttgatctcctgacctcatgagccgcctgccttggcctcccaaagtgctgggattacaggcgagagccaccgcgcctggccccaagaatgtttttcaatgactactaagaagctgtcaatgtgactggtgggagtgacccttcttcccattttccctgtgatattctagtgtttgtattaacaagccaagttgcagaaccacaggggtcacccctctgagagctgcacaacagggacccccaaaatgcaaagacacctgggccttatctcacccccaatggagactttgagggtggggcccagcatcactatttttaaaaaagacccacaagattctgctgtgcatgcggcatgacaggtcataaatatacactaagtatgcacagcctggagaaagagaagagtgacgagacccagaaaattctcgagctgcactgccagcctcggggttactgaggggtgaaggtctctgaaggtgtgccccttcattttgtgcagtctcccaaacagaatcacataaaactgctgaatgatgctgatctgcttggaaagcaatgtccattttcacttgaacatttgtaacccaattccggtgccagctactaccatttcttccctattctggatgcctggaagccagatgggaagctggcggtgtggagtggtctgtgagctgccacatccctcagtgagtctggaggatgcacacaggataccaaggcacatctcactctccaatttcacagcccctcttcttgcgaggctcccgcagggcagtgggggcccaaaagacctcagcaggctgcaccggctccttgcacagacaaagggtaaggagagacccatgcaggagcacaggctctgtgaaggcaggggcctggctggctggtgatctgctgcacccccagggcctcgaccagtgcctggtatgcagcagatgcctaacaatactcaggcaatgaatgagccaagtcagacagattgtggggatttaaatgctgtgtgccacacatgactgcttccttaacctgaaatctgcaagggtgttggcgatcggggccaaaacatgctcctcacctcgaaaactgcctcagcttggcttcaatgcttctgtgcctcatgcacatcctggtgagagcagatccaatctccctggtcccacctgaaaaagcaacagaggcaaaggtgagggatagaagactagcagggatcatggaggtctttagagaactttacaaacaagtcagatttcaccacattgtaaaatataagccaccatctttagaagcttctcaccatgcccatgtgtgcatacacacaggcacatgtaaacatgtatgtacgtatggtgacagatttctgtatcaccaaaactatcaccaaaggctgctcctactatataccacactctgttagtttctattccatctgattttttttgtaatgctgattgtaatctaaaaattgactttacaacctataaatcgaccatgacctgtagtttgaaaaatacttctcatgaaagataatcaatatagtatctgctgtttagggaagagctgtagcttttctcaacaattctgacaaaataatcccgttaacattatttagaacagccaaggcagccacgctagctaattatttcaagacaaatgttctagaatacaagtaattcagagaatagcaaggctaaagcaaaatgaggtaataggactttttttttttgagatggaatcttgctgtgttgcccaggctggagtgcagtggtgcaatcaaggctcactgcaacctctacctcctgggttcaaacaattctcctgcctcagcctcctaagtagctgggattacaggcacgtgccaccacacccagctgatttttttattttttttttagtaaagacagagtttcaccatgttggccaggctggtctcgaactcctgacctcaggtgatccacccacctcagcctcccaaagtgctaagattacaggcgtgagccaccatgcccagccagtaataggacattttttaaatgggcttgagcaacaccagtcttcaagctcagcaaataatgaaggaagttgcagcccagtttgattttcccgaaattctcatcatacttttccccttcaggcacaccttctctaacattatttttaaagctcttctcttccttctccctcttaaaaacaatgcttgaatcagcatttactggggcgtgggagagcaaattataaccacacatggtagttctgcgctgaacactggagggcacaattatgaacattacgaaaacactggtgtttgtgaatttggggaaaagtgtcaaataaagcactatttttaacagacaagaccttcaggggaaagccacagggatctgtggcaggtttaaccatgttgaattggtagaagaacattccctctcttattagtactcgtgacattactatgggttggattttcctgtgccctctcttctagaaatccccatttactatttcagctccacatgttttccatttcattttgcaaaaccatcaagtttctacaaccaaataatagtaactgtgacatatatatcgtatattaatatttctatattttatttcagtctgaagagagaaaccttctgagggcaaggcctctattcctctaaaaacaaggttttctcaatctggacaatgttgacatcctgggctgaatgttgctttgttgctgggctggactgggctgtgcagtgtgagatgtttagcagtatccttggcctctacccaccagaagtcaacagcagacttcctttaacctcacctccagacttgtgatcctccaaaatgtctccagagagtaccaagtgttgggcaacaaatcactcctgttgaaaccagtgctgtaaaagaacccaagcgagggccaagtgttgcccgaatctgacttttatgaccagagtctcttaaaactgtacctgcctccaaagagcaggggatgccacggccatctcagcgttgccatctaccactgttcacaccagggagagccagcagagggcgccgttttcacacactctgccccgccttctgcgctctccaagttctgagctttttactgcatataagcaaagacgaggaacgttttattccccgggaaatatttcctatttctttctgggccttcgtttgattaaaagttaataacccggccacacaaggaaactggcacactcactcactgatggtaagagtgtaaactactactttcctggagcaaaatgtggtagcgtctatcaagaaaagccttgaaatatttttctttgacccagcaattctcatttcagaaatttaacctgcggaaatgattaagagtgaaagaaagtccttacctacaagggtagtcatcgaaatgttgttcacagcgtcaaaagactggaaacaaaatcccattacagggatctggttaaatcaaccatagagcaccaccatgcgatggaattgcacgtggtaatttaaaacactggagaacaacgtttaaggttgcaggaagacgtacagcgcttaggatgtgccaggcactgctgtgagtactctgcacacttcaactcatttaatcctcgcagcacctccagccgcatcagtactgtgaccatcccatgttatagaaaggaaaaatgcccaagtgatttgtcccaggttatgtcactagtaagtggaactcaaacctaggcttaagctccagcgtcaatgcatttatcccctcaggtatatggcacttgtgatggacaaagggagatgggacagagcagagacgagagcctagaacaatgtacaccaaacttattggtctacacgctattacgggtgttggtgctttaaagccagctctcatattttgcttctagagcctggccctgtctaatcagtaccaacagggattgcgctccatccttgctaagctactatagggagttcagggatggagagctgcttcatggataattcatgcctcagtttcctcaagatagaattatgatgttggaaaagatcatctcaaatgtcagtgcccccactccgtttctctgcttcactgcttctgtcaccttcccaggtatttcccatagattgccactggtcacttattatccccaggaaagcccaaggcttctcagaaacagatgaactggccgggctcagtggctcacgcctgtaaccccagcactttggaaggctgaggcgggcggatcacctgaggtcaggagttcgagaccagcctggccaacatgatgaaacctcatctctactaaaaatacaaaaatcagccaggtgtggtggcacatgcttgtaatcccacctacttgggaggagtagcttgagaatcgcttgaacccaggaggtggaggttacagtgagctgagactgcgccactgcacttcaacctgggcaacagactgagactctgtctcaacaacaacaacaaaagaaataaaggaaaggaaaggaaaggaaatagctgaactatggtacaataaaaacaatttctagacataatgtatgtgcctctgtagaacaggaagccctagagaggagaggaaataaagaaccacaaagaaaacttccaaacagcagtgtctctgtccaactggcacgaagacaggaggcagatgacatcctctgtggaccccaggactgagctattagaatcactgctgatctcggcaacatggggcaccctaaaaataggtccatctgtggaagtgcttaacatcttatgctcttcctaacccttgcaagaacttaaacaaaaatcagcaggtttgaataagcttcagaggaaactggcttgagctacaaagacagaagacatctggaagagctcccatttgcgagtgggcatatttgtggaaacaaatggctggctgaggcacacacagcagcttgagtgaagacaaggccctacttctgtgttctcggtacctagcactggtgttgaataaaggaacggacatttaccattttgagagcaaaccaccaggctggccctatctggaggcaggaccagggactgggtttgtatcttgtttaatccccacatacttgtttaaaagatataaaataaaaacaagatgcttaatcttagcaaagttctatattgattcctggtcagcctagagatacaatgctgtattcgtttccctttgctgctgtaataaatgaccacgagcttagtggcttaaaacaacagaagtttattatcttatagttctggaagtcagaagtccaaaatcagtttcactggtctaatatcagggtgtcaggtaccacagggctggcattccttctggaggctgcaggggagaatctatttccttgccttttcccacttctagaggctgcctgcactccttggctcgtggcccctttgtccatcttcaaagccagcggtgcaatctactcccttctctgacttctgcttctgtccttacatcttctctctccgcctccaattttcctgcctccttcttatgagaatccttgtgattatgtgggacccacctggatcatccaggatcacctccctgcctcaagacccttaaccacatcaccacacatcagcagagacccctttggccacgtacagtaacattcacaggttctaggggttagaacgtggacatctttggggcatccttatcatggccattaaaaaaaggtaagagttgtgaatctggagagtgtggcagggcactgtggctgactgcagcacccattcgccctcacatgatcggtctaggcccatgatgctaactccatcccctttggcagtggctgcttcagggatgggacaaagacatggagaggaggctgctggggaggcctctggggaatgttttcctgatcttaagagaaacacaccaaagggttccacaggccacaaacaaggaagcagactgtgcagctgctgccatcagccatcctatggccatggggacacctgcctcaggatgacactgctgtggacagaagagaaagggcctgagtctccagtgatgtcccttagccaccaacccgaacctgctcttcctctgggcctggcaccccagttttgcaagcatattcattttcttatttttagagccactttgatttggttctgcttcttgaaaggagaagaaagaaaggagcaatggcctctcatgcttcttcccagaaccaggaaccaacgtgttgctaaaagaaatctaagttggtcacttgatgccactgcttagagaggcacaaatactttatggcaaaaacataacccgattcaacgtggtacatgtaaaaactttctcccataacaagcaaatgcttttctaataaagcagcacaaaatcagccagtatgatctgtgggtgatctgtgaaggaatcatcagtggaaaggaagaagtgaaccatccaggggctgggctgccaaagcatgactgctgaggcccagcaccatacattttgcatatgaagacacacgatccacaagcgtccactgagtatttgtattggcttttgggggctgctgtaacaaagcaacccaaactggctggcttaaagcaaccgtagttctggaggctaaaaatctgaaatccagatgtcggcagggccgtgctccctctaaaacctacagggagagtccttccttgccttctccttgctgctggtgactccagcattccttggcttgcagctgcattgttcaaatttctgcctctgttgtgctaggctcacggcctgtgtgtgtccatcttcccataagacacgtgtgaaggcattcctgtgtgtgtgtgtctaaatttccctcttcctataaagaccccagtcctattggattagggcccaccttaatgacctcatcctaactggattacatcagcaaagaccctgtgtccaaatggtcacattcccgggcgccagggattaggacatcaacctatctttctgggggtgcgccgcagtccacggcccacatcctaccgtgcagcaaaaactaacgtgatttcaaggacggtgaagacaggtgccaggcccttgagcagcttacaaagattggttggatggacacagataaaatggtgcagggaacactgtcctgacagcaaccctctgtggtaggcattatcagccccatgttacaaatgaaaacacctgaggctcaggagggttaacaaccttgctgagggccacattgctggtcagcagtagagccaaaatccaagcctgcttctacggataccaagggctctctctcactacgacaagctggagacattcccagctgaggacaaagaggcacattaaagtcacaaacagaatacaaattgtttaatgcatatttgggggggtagggaggaaataagaaaagcaaagtttccttgccccctaaagtccgaagtcagattgccccttgctgcagagacctggcagcgacaggcaggacggtgggtccttcgagtggcattgtcctgtccctccaagctgcctcatttgcaggcagctgccatctccctgcatagcaggggactaatggcaggcattcttgggggctacagtgtgggcaggtggcgagcgaggactgaaaagacgttttgtcaggcccagcttctgcagcgtggaggggaagggctgaggaagccagactgaagaactgctttggtgaaagtgtgccgccgtcacagtaagtcactgtgcatctctgctgttcccgagagctgacattgctcgaaggctaattaggagccagacagaaccagaggagaggagaacgctctcaggcatctctgcaggagaggggtgcagggcaggagagttcactagagtggggtatctcggcctcagccctgctgacattttgaaccggatcattttttgttatcaataatgaccattttgggccaggcatgatggccatgcctataatcccaacactctggaaggctgaggcaggaggatcacttaagtttggtctcaaacttctggctttaagcgataccaactagcaacacagcaagaccccatctctacaaataaattaataaataaataattaactgggtgtggcggtgtatgcctgcagtcccagccactcaggaggctgaggtgagaggatcgcttgaactcaggagctcaaggctacagtgagctatgatcacaccaccacactccagcctgagtgactgagaccctgtctcaaaagaaaaaagcaagaaaaaaaggaatgatcattttttgtgtcctgtgtattgtaggatgttttgcagcctccctggcctctacccactagatgccagtaacatccctcaagtcatgacaactagaaatgtccccagggggcaaactcgtccctggtgagcactggcgtaggaacatgcatcctttttccataaggagggctcactgtttccagtgctgttccagggaagccacctgacatgctcactgcaccagtggcctccccgcaaaccctcgctgcagaagctctgaaaagctattaagttcactgcctacccccatcttcataagcacagagataataggcaacacatgttctcataatgaagaaaatgttccacttgccattaaagaaacactaatttgaaaacacacaactgacattccccacaaagccagcaggcactaaccccctctcctatggccttagggatgcattaattcaactaggggcagcttgtgtacaagcccaaaatactggaaatacccaaataactaggagagggagcctgaggagctgcatcagcaggatctaaggccgcagctgtctggttaggaagagctccttcacgggacccagctagaaagtggaggaagaatgggtggtggataagaaagccacctccaaccactcaatggcttgtgacttctgtctggacaccaaccagcaataaacagccagccccaaagtgtccctgaagatgtctacaaaacagcagctggaaccctaacaccagtggttgctccctccccattgcccttgccgcctgctgatggaagggaccctgtgcgcttgaacagcagctcccgttcccccacagtgaaattgattactgtacccactagggttcaagtttaaaagatctaagtagccgggtgcggtggctcacgcctgtaatccccaacactttgggaggccgaggcgggccgattgcctgaggtcaggagtttgagaccagcctggccaacatggtgaaaccctgtctctactaaaaatacaaaaattagccagcacggtggtgggtgcctgtaatcccggctactcaggaggctgaggcaggagaatcacttgaacccgggaggcagaggttgcagtgagccaagatcacgccactgcactccagcctgggggacagaatgagactccgtctcaaaaaaaaaaaaaaaaaaaagagagagagaaagaaaaagaaaaaagaaatgaaagatctaagtaaagtggaaatctttggttcctgggcacataactaccacacacaccaaatataacaaatgtgagtgtaggctcgcctgtgactgtatcaggaatctttttctaaaacagatacacaccaaaaacttacctattgaggtaagtgaccccctcctcccccaaatgacctccaaaacggtcttggggctccttggcagctgtattcccatctgtctcctctttcccacacacttggatggcaggcacactccacgcagcctgcaagccatagagtttcagtagcaacagtgtctctcaccatggctaatctagagtcttagcagagactccttactatcgtctaaatgagcaggaggataagcagagaaccacagggtgaaaggcttagctctgaaattagccaatgtggcttcaaagcccagctcccacatttgctgtctgtgtggtctttgcaagggtctgcctggcgtaggctcaaacgtagatggttgtactacaaaaaaaaaaaaaacaaaaaaaaaaccaaatatgctgaccagtgtctcatgctatctttgttgcataaatcacacccaaaatgcatcatctgtgatttccatgtcgggcttcttgtgaagcaatctgaatatcctagatttttacaaattttgttcccaaatcttttacagttgcctcatccatacttaattcgatggcattttttttttgcaaaagtaacttttattaatatcatatctttctaaacattctacttcttttgtagaaatgacaaatcttggttttcacattcacactgcaaacatttacatagcttataattaaattatttaacaacagtatgtgcaactggcatttacaggtttataagcgcacacagcggatgctggtgaagcctacaacccaggtgtgagaagtgtgtgtgcgcatgctagagagagagtctgtgagcttcctgaaggcaggggctggaatattttacagagaaaataaggagcactggttacatcagtgctcccattaggcagagcggtgatgtagctataagctgagtcctacaggaaggcagaggccggagtaagtaaatgtggctgggctggggcatctgtccataaggacacactggacaacagatcatgacccccactcctcccacatctaatatccactttctctaaggagctggcaaatcagtacttagagggcaaatgaacagtgcaaagggcagctttcaagaaagccagaattattccttcttcccaaacatctcagaagaccaaaggcctagaaggagcggcccagagggcttgcctggaaggttctgtttgtacttattaattgttacgcatccacaacgtggttatttaatgggaagtgaaagctgggggaccgggaggctcatgaaaaccaactccagtgagcctccatcctctgcccccaccccttcaaaacaggaaggccgttgcccttggctgaacagctttttaaagtgaccttgaccctaggtttcccttgactgtaattttttttttttttttttttttgagtctcactctgttgcctaggctggagtgcagtggcgtgacctccgctcactgcaacctccacctcccgggttcaagcaattctcctgcctcagccacccgagtacctgagattataggcgcccaccaccatgcctgactaattttttgtatttttagtagagacggggtttcaccatgttggccaagctggtctcgaactcctgacctctggtgatccacccgccttgacctcccaaagtgctgggattataggcatgagccactgtgcccagcccccttgactgttaatttttatatttcagagctcacaacagttgcatcaccagcttccttccagccaagaatgaaaaggaaagctcctacaaaatccagggctcgggactgtgtcatgggacgctcagggccacttagggacactgctgcaatggctcatggcaggttgtaatattttagtttcactatatgagaaaatagtctctccttcctctcaagcccctgctctcagagagcccagaagtcctaaattggcaggggtcttttcaccttgacggcgggctggaggactgcccgggtgttgcatcacagaagttgcctcagcgtgcatcactgccactctggctggaccgagcagggcaaggctgggtacaccatctgctgccccgggggatgcctggaggccagcactagccacggctacacagctctgcacacacgcacacacgagcgtcagacttgaccatgaagctgggcactcctcttctgcaatcgcactggcatgtttcaggatttttttattttataaggtgaagtgacagaacacagtcttcaaaggaaagtaagagtgtttccaaatggcatcagagtgtgaacctgaattctaataagagaagaggaagctcaattcttaggcctggaaaagttcaatcatgatgccctagctaagacaatgctttacccaaagatttcgaccaggtgtgtccaatcttttggcttccctgggccacagtggaagaggaattgtcttgggccacatataaaatacactaacacaaacaacagctactaaaaaaaaaaaatcacaaataaatctcatatatatacatatatatatatatatataatttttttttgagacacggtctcactctgtcatccaggctggagtgcagtggtgtgatcacggctcactgcaacctccgcctcctgggtgcaagcaatcctcccacctcagcctcccaaacagctggggctacaagtgtgcactactacacctggctaagttttgtatttttagtagagatggggtttcgccatgttggccaggctagtcttgaactcctggcctcaagtgattcccccacctcgacctcccaaagtgctaggattacagatgtgagccaccatgcccggcctcataatggtttaagaaagctcacaaatttgtgttgggctgcattcaaagccatcctgagccatgtgaggcctgcaggttgaacaagcttgatctagaccaaggggcaaaacccaaaaggctagtaggtggacaactataacccagaccaacaaaataactgatcagtaaggaagctccaggcaaggggctagccagacctcggctagaggtgggtacatcagcctgggggtctataaggtggatctcttaggtgatctccaggttagactggatgacccctcttcctggcaaccaagatgctggagtggagaaaggacagtgttcctgtagtcaacaaatttttaggaaatgttaccttggtctaattattgtgctacgaagtaaagagacagccgcctgcccccatagagtgggcatctcctgtaattggaaatgacggatcgtcatggtaaccttagagctggaaggtgccttagaaaactcacaaagcaacaaaccagcagttccttgctgttgggcatcccactctttttgttctttctgagatgtagtcttgctctgttgcccaggctggagtgcagtggcaccatctcagctcaccacaacctacacctcccgggttcaagcaattctcctgcctcagcctcccaagtatctgggattacaggcgtgcgccaccactcctggctaatttttgtatttttagtagagatgaggtttcaccatgttggctaggctggtctcgaactcctgacctcaagtgatctgcccgcctcagcctcccaaagtgctgggattacaggtgtgagccacagtgcctggccaggcatcccactcttgcctttaattagcagagtgctcctgatgcacgcaggacttccacgcttgctgctgtttctcttgttcagggaaactcatccttgttctttaagctgcacatttatgaggcagctggcccctgccaaaaggaccatcattttcattaaaggtcaaagtcagcactcaggatattaagaacttcaaatgaacaaactgtgttcctctggcttcatcagcattttatttttacccttgggcatggagagatggacaaccagaagaaagtggcatcatttgatgccctacatttgtttaactacagggaggggaggcagagagggaggaaatggagaagcaaccagtttctggtatcacaagtcttcacagagatcagactctgttcacacgagacaaatatcccctctccaatcattagagaccctggtcacacataagtcactgagcagcgtcctgataccttatgttagccttgaaaatggctgcaaaacacaaacttttttgcctgtgccatttacaagatcatctcagtcgggtgtgtccaatcttttggcttctctgggccacatggaagaattgtcttgggccacacttaaaatacactaatgatagctgatgagctaaaaaaacaaacaggctgggcatggtggctcacctaaggttgagagttcaagaccagcctggccagcgtggtgaaaccccatctctactaaaaatacaaaaaattagctgggcgtggaggcaggcgcctgtaatcccagctactcaggaagctgaggcaggaaaatcgcttggacccgggaggcggaggttgcagtgagccgaaatcaagccattgcactccagtctgggcaacagagtgagactccatcttaaaaataaataaaataaaataaaataaaagcaaaaaaaaaccgtttcaagaaagttgatgaatttgtgttgggccacattcaaaaccatcctggggcgcatggggccaacaggccatgggttggacaagcttgatctaaatgttcttacaacaaacacacaatctgatttcaaggaaactaagagaagagaaacattagtcctttaagctgtgaaaataggttccttaggacaaaggtaaaagaacttgaaaagatattcaaaaataaacccataaagcccccaaaaaaggaagtacaacttcccttttgctacaatggcaatcctaacaactcattttaatcttcaaggaagagaaaaacatgcagaaaatttcctgtgtggttttttttttaaaaaacctgttttattcagctactgtatacagctgagtatgtaatgaataacccagctggtgtttacgggacagctaatactgcacattcagcaaatgctaggtagggtcagcatcacatttttggaagacaccattgtgcccacacacagggtggaagacactgcaaactgttatcagatgataatcttccagccaatctcccacttctcagtctctcccacttcacgacttttcaaaaagcagaggaaacaaaacccacacacaatcctaccaccatctggcggcttcagaccagcaagcatgagattctggcatgcaccgtactggcagccacaaagaccaatattcctctttgttgctgttttaaaagcaaagcgagaatggtaatatggaaacacaaaaacacggacacgctcacactatgggaaaaccatattaacagcaaacacattccgacagggaggcttccctgtctacgttttggatggaatggtgtctggttgcaacaccctgtgggggtgtcacctgggaaatgccagctgtctccccgacatctgccaccatgaaccccccattgccatggtctgcctctgctgcatgggcacagaaagatgctcctgctgaagccaggtctgagcgactcgatgacgccagctcctgccagcgaagcagctgtggcctgatgcagaaaccacatgtcattttcttagttcacaaaatttaactgtcgggtagataagatgctcacagtatctggatcagggattatctcccagtcagccttcttgggttgtcaggtaattcagaaggtggccagatgaatatggaatcagaatcagggagttagtgttctagggatcagagtaagagcctgctacatctatccctgacaaagggatggctctaagctgggactctgcggagacagccctcgcactgcctccctccctgccctctcgctgcctccctccctgccctctcgctgcctccctccctgccctcgcgctgcctccctccctgccctcgcgctgggctcccgttggagatcagaactccctgtgataaacatctatccttgaacccgctagcacctaaaatcaggtttcatgcatgtgtcactggcctaagagctactttattcctttaagaggtttctgtacatccccaaactatgccagaatatagcgactttatcatctcttaggaggtaatcttgcagtttttcatattattaggaatagctcccatttactgagtgcttgcaacatgacaaacccttgcaggaatgttgtattcatttttttaaaatctcattatactcctcttataggtaccattataaagtaggtatctcatttttttttttttttttttttgagacagagtctcactctgttgtccaggctagagtgctgggagtgcagtggtgtgatcttggctcactgcaacttctgcttcccaggttcaagagattcttgtgcctcagcctcccaagtagctgggactacaggcatgtgccaccatgcccagctaatttttgtgttttctgtgtttggttttttgttttttttttttttttttgagatagagtttcactcttgtggcccaggctggagtacaatggcatgatcttggctcactgcaacctctgcctcctgggttcaagcgattctgggattacaggcacccacaactacgcccagctaatttttgtatttttagtagagacggggtttcaccgtgttggccaggctggtctcaaactcatgatctcaagtgatccacctgcctcagcctcccaaagtgccgggactacaggcacaagcccctgcaccccgccaaaagtaggtatcattatcctcattttacagatgaggccaagggtactcagagaggttaagtaacttgcccaaggtcacacagaattcagaatttacatccagggctgagtcgatagctagaactttcaaccactccattcttgggggcatctcactgttgccaggacattaccaacagaaacatttggcagatagggaattaggttttcttcccccacccccgatcctataactgggagaaaataagagcccttcccccgaacatctgttttatcagccagattcaaaccgtgctgtcgccacttcctcgctcaactgtgtacagttggccggtctgcatccaaggccatgagttcagggtggacatgtactgtcaggcttcagcaggaatcacctcctgccagcttcctttggcagggtacactgcttattcatgcagaggacccctccttatttgccaggacaatctatcctgaaatcaccctttcagccactgactcccctccgcaacctgtcttagcaggaggcatcttcaggacagcttcccagggatggccctgggaatcatgcttagctgaattcaggatcctgttttctagaaactgacgttttagaaacagcttcagacatagaaggagctcaacaaacgtgagtaagtggaaccaggcagacatgccaagcttcgcgttctacgctcgtaatatttgctcttcctcgattctctcctggctcctcctcatccctcttccccatttttactgcacacctttactgagttaaagttctagaggaaaagtggctgcaactaagccaagactctatcaaaggcccttgagggatacaggccagggacagaggatgcattctgcagttgatttcccggccaaactcatctggggtcatttaaactaactcgtatactatcttcttctcctcctctctatctcttcaatttctatctcaagtcataccttccccagatggtttctgaatgagtgtctggatggtttctgatctaaacagagtttttaaaaaaggaattgaaattctaaccccggaatagcaaacaagaggctggcttttaccattcaacagagaaagcaagtatgaggcttgcgcaggagagaaagcagcaccgtgacacgaccaaagtgcccttgagtccctacaagctagacaagcccgagcctcccagcctccatctattcaatggaagggcataactggttttagtttctagctcccaaatcgagtctcaggtcaagcagtggtaatgtgaatccaaaaactattctcagtaggtctaaaagcctctttactgctcaggctaacttaagcactcacagtcctttgctttctgttggaattatataaagcccgataaaaatgaccccaggttaacagttattatatatctctacagaaaagggggggcttaattattacttaaaaatgtaatttgttcggtaaataagattttacaaagcttgaggtaggtcagtagagattggtaacgtggagagtcctcagtggttagaagccactgctggaagtggaagataaaatgtgtattcccaaaacattttcccagtcttgcccaattaccatgaaaatgggacatgattctagcaccctgatgaccttctgaggttaaactaaactgctctgtattagatgcccctctgagagctggtcacatcatgtaatgaagactttactagataactcaagccactctggttcctcttccagttctccttctcctgcactgttttcttccccacacccactttattaactgtgttcttctaacaaaatgcagataagaataactaccaatgaatgactgaaacctgactgtggctcagtcatcagttaggaagttgccagaaggcaatgggattgtgggacacaggggctgaccacatgtcccatggatgagcactggagccagggtaacatcatggcctcgcctcctccagcaatatcatggcctcgcctcctccgacaaggtcattgcccaactgcagagaaccagtagggtctggtttatcgccactgtattgtgcatgttcaggttgccgacatcttttcaagcagtgggcctgagtgttccttcccactgccctggggtatgatgggggtcctaattcccaacacttaaggcctatgcaaacagctgtttccttgttttttatgttagttacttttttagaatgagctcttcatagacaaaggcaaggatggtaaatcagtttatctcttgggctaattctgatcaggtgtatggatgcctggggcactgtgtggagggtgctgtgggcagctatgcgctagatggaaaatggattggctagatcagctagtaatgtctgctacaaccgcaggacagtggaaggatgcagactctgtatttgctaccctgggcctaggatctcaaaagagagctcaagacacaacttattaaacttcagtatacacaaggatcaccaggaaattgtgctaaaatgtagattctgatccagaaggtctagagattcagcatatctgacaagttcccagaagatactgacttgctgctagactaccaaccacacttggagtgaaaggggctagaatgtttcaccagccagaatactttccccagctccctgagaacatcatcaccacacagagcccctgccaggtgaaatccagctgacgggatgtcctgagacagtaaatatgactgtttgccagttgcaccactaaaggacacagggtctgctgctgggacagtctcctgctgatgaagcttctccacccctcgccttagtgtcccatcccaaaccacactcttccatttaaccagaggtcctcctaccaacgagtgaaatggcaaccccggtctagaggaaagggagagcatgggagggctgacaacgtctcagggcaaagtggctcgacagcagaagagttaagggtcagaaagagtccctcggttcccacctgctcctatctttcccatgtctaggacattcacgtaaccttcagagtgacttggtataaaaaggtgggcaaggagtaagcttttatcttctcccttgcagaggattagaagtggttcagaggcctccagtccttgcaaataggatgggatgcctttgttcaaaggcagggaaggaaagagagactaaggggaccaagtgcattctcacacttaatgcgctgtcctgggcttactgctccacgggcctgtgtccttcattagacagcgaccaccttggaggaacaactacgtgtgagccattcctgaattctcagtatctagcaaaatgcatgacttagaataaagactcaattgatgtttgtagataaaggggaaagagtttaaaacttggacactatcctattctgaagagcaggtactcctgacattttggcagctgagctgactctgagctcctggggtggggggaaatgagacattcttcatacatatcagactcacccatggatcccctctccctggtgatgtgcaaacaacagggacaggagatctggaccataaagctgtgagctccgggaggcctgcctagtttgtgattcaaggtcatctagggaaagaacatatgtaactgctaatctaataaaggatatttagatcaatcctcagcttttctgcctgcctgtcaaataaaattaagtatatgagcacctactatgtgcaaggtattaacaataggatcgtgattcttcttccatattagacatgcacaaaagaaaaaaatgaaaacaaaacaacgaatcaagtcgttttattttgtgacatggggctgatacagacctcaaaagtacccataaggctggaaccgggcccattaaaatgctcacagtactcaagacatatttttttagaagataattactaacaatctctgaagcttcaggtccccttatatgctacaagaaaagccttcgcgggaacagatctgttgccatgacaacaatcacttggctgcgcataaagaagggcggggaacctaccaaatggtattctcaacagtcagccctgggatttcttaaagccactttctaaagaaccgtcagcatctaggagaatctaaaagctgcatgagaccttaggggtaacctagtttcacatgacaccagaatttcttctttatcgtccctgccaaatagtcatctggactcagttgaaacatctccaggaccagagaacttgctccccttcatgccaggaggaagatggtagggagctttcttcaatcatccctggagtgaggtgaacagaggtacaagaagggagggagtaattacctgaagaaccttcccctttccaagcagcaggtttaggctctggcaatgcctgccatgagctcaaggagcccaaacgaaacaaaaaaatgcctggaaggtaacttctcccaggtctccaatacagagctagtttccaattctagccattcaatgccacctggaaatccatggttgtcactgttatgctacatggaaacagcaccaaggaccctggtggtattccatgaaccatgtggaaggctgcatggggaaacccacagccaggtgccttgtatccacatgctgtagaaacagtgcacgtgcctgagtacacatgtgcacaaacccaccagacagaccccccccccccagcatgtgactcaacagtcacctctgtagagcatcactaaagatggcttctcccagggccctgcccatcaattatcttttgagacaaatgcacatggattcttaggtaactcacaggggaatatatttgtatagaccaagattgggagaaagagccaggggtgagctggggggattgctgggtaagtgacgtacatcacaaaagtggatacaagccccactgaaggagaagtaaataccttgcccatgtgttgctgctacaaggagcggcgtgacctgtggaggagactttcaggcccagccgacctgaacacacgacctccagctgtcagctggcatccccccattacagtgaggttccaccaagacaggtgcctgggatactctcctacaggcctacttccattctgtccatgcagaacagaccctcggctcccttcaattcaccacgtccctcagctcaccacccacctcaacactttacagatggcctttagataccatcggcatctttcagtaatcactccgggctgacacagtgagacctgggaccaccatcctgaacaagcttaatggcccatttcatatgagaaagagaatcagaaatattaaaaggaaataccctgtttttaaaactccagtttacttagtaccttatcagtaatgtctaccatcccaaaagaagactggagaaataaaacagatttgcatgacgtaaaatgatcttgatctcagacactcaagcgtatttgcacagaagcagatttgatgtgaagatggcacctgtgaacagggacctccccagaaccaaagcttaccccagggacagctctgctgcctgtggggctcacagaacgccagaatgcagcccctgggcttttctaccaaggttcccaatcaggaacccagcactcatttggggaagaacctagcaaataatcttaatggtacttaattagcaaactttaaagtttcaggcaggaattatctgctgcaggaattagtatcgatttggtgagcatcctacaggggtgacattggaccactcccaacagtttcccccagcagtaacaactggggaaaaaagaaagcacaaagagcagctcctgaccacaaggcagaggacaaagagtggggcaatggcaggagcagacacatcctcattacagaaaagaagccagggtcgtccccagctgtggaactggcagccgccatttccagatgactgcacatgcccacaggaaacggcataggcagggtagtcattaggagagaagagatttgcattcacataactgagaagacaagcttgcagtccctgagatgctggtttattttaggagacaattacccagttgttacaaagctgaaactgacctttcaggtagaaatcttggcatcagggatcttcttgtcttaagcaggaaaaactgagattttaaagaccaagtttaaaatgtgtgtgtgtgtgtgtgtgtgtgtgtgtgtgtgtgtgtgtgtgtgtgtgtgtgtgtgtacgagagagaaagagagacagagagagagaaacacaaagaaacacaagtgaacctaacggcagggacagatttcatcaccaggcaatactaggtcactagattaacactgaattgtattcagcccacaaacaaacattcgaaagcagattaagaactgttgtgttggaaaacgagattaaacaaatcccattttcttattttttttaggttcaaaagactgaaacccatcaagtgaattaagtaaataggacaaccaccatccagccccactaaacaagtggacaaattccgtaggcaggctatccctgcaaatttcagttctcagaaagcagagcacggtgctatgacaggaaaaaaggtctcaggggcatttctgtggccctagaaggatggcctatttcctgaaggtatgcatctatacctaggctgtctctcaatacactcagccgcccgaggaccatcttacagatgaggagcaagactcagagagcagaacaattggctcagggcaacccaccgaacaggagtataccacagaggttaagattcagggttctggagctggatatccctggtcactgttccagctctccctccaaccaatggtataaccttgggtgacatctactctgaatctttgtttcttcatccaacaggagctgctccacagtgttatcaaggattgaatgagataatccaagtaggatgctgagtgccaggccctgtgcacacgtagtcagatcatcatgcaattaacacgcaaacctacagctgtcttattctagacctcttcactgcctttgtgtgcacagcttcatgcaacaaaagactctcagctaaatctggttttggatttacttctcaactcattgcaaaatgtatttgagtttcctgtttcatgtatcaactcctatgcagaaatgtgtgtaacaattgggaggagagtatcactgcctccaaagacagctacagaaaggtccttcaagcctatgggggctgctacgtacagctccacaggtagctgactgcacaagtctaagagaatgctatttccatagacaatgagtcatgggcatcctaaagtctggtttctaccccagtcaaatccagaatgagatctgagtggaactgagtcatggcactgcctgctctgctgccccatccctttctttccttttgttttccctgttggtaaacttcaaactacattaatttgttctcagccacagcaaggtttaaaagttagggatatggttgggcacagtggctgtcatcctagcactttgggaggctgaggcaggaggatggtttgagctcaggagttcaagaccagcttggacaacacagtgagacctcatttccacaaaacatttttaagaactagccaggcttggtggtctgcatctgtagtcccagctacttgggtggctgaggtgggaggatggtttaagcccaataggctgaggctgtaatgagccatgatcatgccactgcactccagcctgggcgacagagcaaatacctgcctcaaaaaaaaaaaaaaaaaaaaagggtaggaatatagcaagaggtggtagcaaagacatgggtcccgccccacacagctaggggaaagaacagggggattacctgctactgaaaccttgctcaattggaggccaggagctaacaccaggacttgtcacatttataaaaacaatcacacattaaattctcaggaggttttactcatctgagagtgaggccgcaataccatttccctctcctttctaagggatgggtgtgtttcttttcccaatgtggagacaggggacactcacctttgtcctcatcatgggcatggaaaaaccatctctgatttccaaaccagtggcagagccaccagcaaaggccaacttcacaaagaggcgcaggatccagaagactatgcttcagctgttttggaaatgggtatgttttttccccaaagaaacaatgtcatgaatggtagttaagttctcaggctggcctgcaaacttaatccattatatacccgcatcagatgctactgaacctgaccatgtcccataacaatgtttctataggaaagaagtacccaatttcaacctgggacatggattttagtgacaaggggaaaagggcagggggaggaaaggaagaggctcctgcctttgaaagaatgacatattttatgtgtttactaaatcatccatacctaccatgcacagactctaggattagtcaataaaatagtccttgccctaaaataaacacaggcgcagtggtacaaaatgacagataaacagtactggatgacacaatgtgataggaggagatcaagaagggcttgtctaagctgagatggaaggaagacagtgtatgttggaggttccagaaggcgggaagatgcagcgttccagatgaacagaagagcacgtgcaaaaaaggcctggcagtacaagagaacagtgcgtgcctggagggtctctaaggagtccagtgtggccagagtgccagggatgtggcatggcagtgagaggattaggttagagcaagagaggcaggaggaggccaggcctggaaatggcttcaggaaagccatgctggggggtaggcagagctctcaccccaaggcaaatggagagcggtggaaaggattaaaagttagggatgtggccacgaggtggaagcaacccaaatatctgctggggatgaacagataaacatatacatacaatggattattcaggcctaaaaaaggaaggaaatcctgacacaggctccaacactggatgagctctgaggacataatgctaagtgaaataagcccgccacaaaaggacagatactgtgattccacttccacgaggtgtctagcagaatcacactcacagaaacagaaaggagaatggtggttatcaggcactggggggaagggggaaaatgcgagttgctgaatgggttcagagcttcagttttgcaagaggaaaaagtcctggagatctgtggcacaacactacagaactctacacttgaaaatgattaagacggtatatgttatattatgcacactccaccacaactaaaaattaaaatttttttaaaaaccaatgatctcattatagctttggtttctattctggggatgattctggaggggaaactgaggcaagaacaagcagtgcctccttccctaaccagatcagcctagaactactggtggccctagaaccagccgttcaggatcacaggaggaagggctgaggccagcacccttctcctggtcagtgccccagacgctatggctattatggcagccgggccccatggccttcgaccttcaggattctcctgcttcctcctcagcatcactcttccctttgccaccatcagtggtgacaccagcacagatccacacggctctgggccacctccgcctccaactgaaccaagagtgcaagttcatgatgccaaattcagggcacagataaaccaaaccaacacattcaacatgaacatgcaaacgctctgctgtgatgtcagaagaggcctaacatcctacgcttcagcatgcaacagacaagattccactgcaacaaactgcaaaggagagcctatgtttatttgcactggatttgcagggaagctgctggaagtaagacccttgacccaggcatcttctcatgaggtttttgtcattgctgcggctgttgttaagtgtgcctgtttcaggcagtaaaaaaaaaaaaaaaaaaaaaaaatcagctttattacttgagctcagcccaccaatatgcttcagtatgttccgacatcctgcccatggctagattatgtgacccaacccccatatgtcagtgctgggcagaggaaaaataaaagcaaacaagactgtccctgctgtcagtccaggtctcaccagagagtgagacacataagcagacggaaacggatagttcccaggtattagagtagaggaacacaaaacataggagagaaagggatcctttggactcccccacattcttcagcaacttccctgtctgattctgcagtgatttctgttgctacaacttagaacctagactgacagtatcagggacagaactaagcccttctcaattcactccttgagcaacgaggcactcacttgttgaaatcttcagattatgagactgacgtgctacctactgcgctaaggaggcaactgagttgctgaaatcttgattgctttttcatttcaaatttgaacctttcatttcaagtttacaaaaatagggatcgattaacaatcagattaactggcatttcatctagagactagcaattcacctgaactttggcctgccacaaatcccactgtttttctcattaggattacataagtggtaaaccaacagatggaaatgctgtccataagtggtaaaccaacagatggaaatgctgtctggtcagagaacgagggcagtgtctaccgctaccacacatgagtgtgtcagacttcgagtccatgcctaatgttttttccagaatcattcccagaataccagcggcaagaaaaatgattttcaggcaggcggggcaactctttctttgctgttctgtgaaggaaaccaggagctgcccctaaggggcagggtctcaccacttgcttccatttctaggagatcaaggacccaccagagagcccgctgggtcccagggggctcccattcagaccgcgagcagacgtggtggcccaaaggcctctgactcctttaacccatttatcctaattttcctggtcaattacaaagagcctggaattcagttctttcatttcttatgagagaaccatgagagctgggaaggttcttaaaaatcatcttgcacttcaaagagagatctcacctaaaccagagattttcaagagaataattttttatacggcagcaaccccctattttaatttgggatgtttcacagggcgagaggggtgcaggggatctccacagattgccattctccagccccaccacaagcccctgggcaccctctgcgagctcacctacctgatcatgccactcaaaatcagagtggacctggagctcagtgacctcagagatccaagaaagtcacttggcaaaatttaccaccatgttttatactcctcgcttgaagtagtaacctggtgctaagcaacgtctagactttatttctaaaatccctgacaactctatgtggcaggcatgaatattcccatcatagaagaggaaaatgagacacaaaggctatagcacttccaagaggtggcctggcacattagccctcattacgccctgactctatttttgggagatgaattatttacgtgggttatgcaggttttctgtcttgggtaaagtatcatgtaagagtactcaccccttctaaatggactgctacctaaatacttcctataataacattctcaagatgcctttgaacagagagggtaaggaacctgcctggggtcacacagctaacatgcaagggatctggatttcaaatgaggtcatgtgcctccaaagcccatacaccagactcctcagcctttataacctaaatctcttaggctgctgctgcccaggcctgtctacttcaaagtcccagacctcagtggaaggcaaacaggcagccaccctctacataccaatttttcccaagcaaatggacaagtacccaaaacaaacttttctgtttcacaacatttctggccttcattcatgccaagagtaagcaactgttgcatcgttccacatgatcacaagacagattcccaaagatgacttcaacagggcagggtctgtgtaccaattttttcatttttaatctgcagttgacaaaactaatacttgggcagctggcagagtagactcggtgaacatgctgctgaaaccacacttgctctttatgacctgggaccaggttgaaggacagcaactaggaacaggagctcagagtcattctttccaatccaaaggagacaccaagtatgaggtttcctgcatttgccttcacactggctctgcaatgactctggtagctggcagctctccataatgtagctgtctgctcatccacagtacaacaaacaccagaccagaagaggggcttttcccagatacttggaaaaaaggagaagaaaacaaatacaaaaagcaggttccaaggaacacaggaaaacagatgcaaagcaatcttagattcagtaacttttgcacatcctcagtgtcattttacactaacacaacagtgtcatggctggaagatctaaggagctagtgctttgctccaaatgatttggacagatgtttactaagtttgcctttctaaaattttcttgtacgtggttaacggcaggtgattaatattcatgcaaggaggttttcaccagaatttcatggagttgacatctattaaagttaacagacaaaaaggcagaactgtaagtgttcttttaaactggcatctgagagtctttgcaggaaacaagatcatcacaacctgccaacacacgcacttcaggtgacaggcgtcccggcagctcccaaatgctctgttcttgctcctgcttacctcccagcttctgtacacaccgttcagctgcttacctcccagcttctgtacactccactgctgggatggtgcccttctcacaggattctgtgcacctctaagacctcgcctgggtatcacctagactgagcagcatttcccatgctctgcctccaagggacccgcctctctgcctaaaccagacccctgtgccccgtcacacccgtcctgccattgtctctttactttttgtctcctctgccaagactaagcttcttgcaggtggggctcccctctcttgcacggtgcatggcacagagcagcactcaaaaaataccgctgaatgacgttaaagaggaaaggaacaaatcactgtgaaatttgggagggaggaggtgtcattaaagccaatgggaacacaaatgaacctgcacaaaatagatctggttaatcttttcagacttttttttttaaaggttttctgcaatcactagctggctggatgtaagcatcatggaattcagactcctggcaccagaagggcttctaggtcatgtggcccaacagctccataatgcaggaaacatgtgtctgctttatgatgagtccaacacattgctgacgctctgtcgtcctggcagatgcggttccctttagggccatcagcggcaggcctggttttcagccaggcaataacagtacaaaaattacagcacaactgtttttcttttcttttcttttcttttcttttctttttgaagacagagttttgctcttcttggccgggctggagtgcaatggcgcgatcttggctcactgcaacctccgcctcccgggttcaaagcctacctcagcctcctgagttgctgagattacaggcatgcgccaccatgcctggctaattttttatttttagtagagatggggtttctccatattggtcaggctggtctcagaactcccagcctcaggtgacccgcccgcctcagcctctcaaagtgctgggattacaggaatgagccactgcgcccagccagcacaactgtttttctatccactgctttaactttctcctgttcatcatcttcaacagatgcaaagaaagttagcagttggggcttcatacccaaacttgggcatttttgtctgtgggaaaatgctacactaaaatcttctaagagaaatagcttttgctcctctctagaaaatccaaggtatttgtggagggcatcggactggctctacaactcccaagggtgtctagcaaggtcacggcatgcattggacactccaaatatttcacagttgatcttttaccaacataaaccctgtgtcagccacatgtcttcacgtccacaggccttaattccttcctcctgaaattcccatcaaatggtacaagcagcagcacaggctggagtcacctaaaaagctaattaagtacaccgattttattgctagaatactcaagtcaggacctgaccacaggctgagcacagatgttagtggcaggaatggctatcttgttaacatagtaataacactgagaagaggaagaaaaaaccatgaggattttaaaacatcttttcatcttcctgcataaaaaattaaattaaaaagaagaacaatggaatttcaacgcctcactgagctctgatagagcgaatgaaacagtatcgtgaatggctggacagggaatacagtttcttgcattaaacaggatcgcctagttcagaggtcatccgcacccacattccagccccttcctggtatccctctggggaatcaagaccagggaaggccagaaaagaagaagcatagctcctatgatcccctggaatccctccactgataaaggcaacttccaatgactcctcttccttcccacgcatcccactcttcccctttcctccacccaaacccacaaaggaaagaaaacaatgacaatactgcgatcgccatgactctgacctttaaatgttgaaccagagatctattaagggccagataaaaaagcaggtgattagttttcaacatgagtcacaatatccctgcagtgaaataattcaattaaatatttaatggtcttaggttttgtttgaggcactgttaatgacagtctcattagccccagccatggtctcagaagtgaagtggaaggggccagctccccaggagggagaggcacttggtgggggcagtcttccttaaacagggactggaaagccaggcccatgggcagaaggggtgtctgccaggggggcatcagtaccgtcattccaatcatatagaagcaccaggcttgatgtgatggaagggttcctatcactttctgtttgtgtgtttttttttgagacggcgtctcgccctgtcgcccaggctacagtgcagtggcgccatctcggctcactgcaacctccacctcccgggttcaagtgattctcctgcctcagcctcccgagtaagtagctgggattacaggtgcacgccaccacacctagctagtttttgtatttttagtagagatggggtttcaccacgttggccaggctggtcttgaactcctgacctcaagtgatctgcccacctcagcctcccaaggtgctgggattacaggcgtgatccaccacgcccagcccctatctctttccccagagaaatccttactaacccttagagagtcagaaagattcaaccagaaagtgggttctgggcacttgaaccatccgtttcaggtttgggtttggtttactttctctcagtgatgcaccagcacgaggtggcttcactctctcagttaagaacctccctgatgaatgagtaaggaaagtgtgagagacagaaagagaaagagagagagagagagagagagagagagagagagagaatatgaatatatttttcagccttaaaaaagacagagatcctgccttctgccacaattcggatgaacctggaggacgttatgctaagtgaaagaaaccagacacagaaagacaaacactgcatgaccttgcttgtatgtgatcttacttataggtggaatatatttttttaagtagaagacatagaaaataaaacagtggttaccaaggagcaggggtgggggaggtgaaggaggaaacgggagatgtaggtgaaaggacgcagagaggcagatatgcaagatgcatcgcccagagacctaatgtgcatgaggactcctagtcaacaacattgaattataccggggatttctgctaagacagtagattttaggagctcttgccatattgaaaaaaaaaaaaaaaaaaaaggtaaatgactgggtgcagtggctcattcccataatcccagcactcttggaggccaaggcaggcggatcacttgaggtcaggagttcgagaccagcctggccaccatggtgaaaccctgtctctactaaaaccacaacaattagctggtcttggtggcatactcttgtaatccattactcgggaggctgaggcaggagaatcgcttgagcccgggtggtggaggttacaatgagctgagatcacaccaccgcactctagcctgggcggcagagcagggagtccatctcaaaaaaaaaaaaaaaagtaattatgagaaatgatagatatgttaacttgcttgactatagtaaccatttcactaagtgtatcaaaacttcatgttgtacaccttaaatatacacacaaacacacaaaagacaatcttccctgacccggaaagtagggagatggggcccaaggcaaagtcagagcacagacgagcccatccctgtgtaacagtaagaacgatccagcctgcttgcctttctcacaccttccaggagggcaggtcactgcgatgagaggaagcactcaagtggttcctaatccaaagaactgtcttgactgaaggattccaataagaagtctcccacaagccttgactggctgtttcagagtatggttaccctactgaaaattgtttaacttcaaccctatttcttgtcttctgaactcacacacgtttatccttcttacgaagactacacacaactaaactgcatgtatctgtgctcatatgtctatagtgaacctgtcatatgtcctcagacattttttccagtaaggtattgatcaaccacctttgtgagcagcaacaggaaaggcaaaaattattggaaaatgtggttaggctcaattttgtgaatgccacattttcttttaccaaacataaccaaatccaacacctaaaagagttagatgccctggcccttcccccaaacaactcatctgtccaataaacacttgctggcttcacaaattggcccaaaagagagaaatgcataaaattaactgtccaatttaagcatttggcctaaaaaaaccaaagagcacctgaaacactgaaggatcttctgtgtttttttgtttgtttgtttgtttgttttgagacagggtcttgctctgtcacccaggctggagtgagtgtgcagtggcgtgatctcagcttactgcaacctctgcctcctgggttcaagcgattctcctgcctcagcctcctgggtacccgggactacaggcccacaccaccacacccgactaatttttgtatttttagtagagaccgggtttcactatgttggccagccaggctggtctcaaactcctgacctccggtgatccgcctaccttggcctcccaaagcgctaggattacaggcggaagccaccttgcggggcccgcgctaagcaccttctaaaactcactgccatcttgcctttctctgggaaagtaaggaaactgcctcctttcttgtcagctcatcgaagctatcaaccattgcttcgtgtgggtgaactgatatgtgctgttacaccagcttaaaacaaaggagagaggcttactttcaacccccatttcactcacgctcctatttgaaaaggtttgtcactgtgcgaagactcatataggacagaagaagaagacagcccccgtcctcaatgagtggaccatagtctggaggagaaagcagcaagcccacaatttattatttttgcactatcagagagctctaagccaaatggctccgcgttcagacagcaagagtgcacccgctttctgagcagggaagggacgttttcagaagatcctcagcccaggttgtaaaaagagaaactgggaggcatggaccagacattcagagaactggtgagcaaaagcagcctagactcaggttgacgacgtgacacagaaaaagaaaagaaagggatgggtacaggggaatcacaggggcagtgtctattcagcctggcagctccagagtaatgacagaggcagggctaaggatcccagggcagtctgacacttgaagcccaggtacctccacctgggagtcccaccaacaaataatagggaaatcaggagaaggcagtttggtttggctgagtctcaggtgccagggggaaggccaaatatccctgcaccatgccagccacgttgatggcgctgaaataaatgtctgttcagatgaatggagaccaaccaccagacggctggaaatgcgaaactgaagctgactcaaagaggtggatttgcgcagagcggggaggtgtgggcacaggaatgaatgaggtctgcacacaaagctgtttgctaccctccacattaaaatggcagatgtctggcaaatgcctggaaatttcctgacacccattgtccttgtttcatagataaatgttctacatgacatgcccatatttccctagccacagacctcagcggctgtaacaacacgtgccccaaatctgtcagggcctgggtgtgtggatttcagatccaaaaatgcaaatcttttcttttcagagaaatggttttctgggcaggattctgggctcgggagccagaaaggagactgaatgagaaggcattgtgcaaatgattgtcatcctcgtctgccaggatcagattcgtgtcctgcctctgcctctctttagttacatgaccttggaaaggacacttgatctctctgagccttggtgggctcatctgtaaaatggaactctgtacctgctttgtaagattcttctaaggatcatcgaaaatacatggcaggagaatatataaaatgtaaagccctccacgtgagcaagggtttcttggcaagcagctgaatccttctaatctaggcactgtacctatcaaaataattctggctcattcgtgaaggcagaattacagtccagggaaatgagtgcatggttgggaacctaaggatcgcaaatgctgaaactttagacagaccagcattttcggacacagacgttcagttctccaacacaggcggctttcatggcgaagttcagctggtatagaccacctgctggcgaggcaactctacccccagaagcagccaagtcccggctctgagagagaaggccagttaaggcactccccctgaccccacacacaaaaactgcagctttgagaattgtgaaagaggcttaaatgttccagctgcaagtgtagctatgctgccttctttaaatgcatctagttccttttatttcaagatgaacagactcccaggcactgctgcaagatacgaaggccacacatccattttcatgagcaaaccctcatccacaacactgttttcatccaagaaatccagacatcaggattatatccatgcaaggtccccactgcctctctccctcccctctcagttggctccagggtcaaattttctgtaggctgtgactttagtttaagcataatgaacacctactatacgcagcaggaaactgtgcagagtctgatgaagactgaaagggagaggctgcaaatcaaacccaaatagaactctagggccaggtcttttaaccatggcaccatgttgaaaaggatggtcataatgaggataaatgaaaggacaagacaaagtcaacagcacagtgaatacaaagggctatgggacaggaagttgcaggtatgcaggtcttccaggagtggaattatttctcaccacactgagccattctagtgtttcgtcagttcttttcttgggaacattctacacacaaagcactggcctgggccagtccaccaccagcttttctgccaggatgcttgagctaaaaaatgatcctataagccaggcatggtggcacgcatctgtaatctcagctactcgggaagctgaggtgggaggatagcttgagcccaggagttcaagaccagcctgggtaacctagagagacccatgcttcaaaataaaaataaaaaaaccaaacatgatcctatagtcaaagtagctccagtcaaaaggattttgagaaacattaaatccagaaatagcaatcttatccactgggctggaggggggcagagtgtgggatgaggatctagtaaggttccattcaacaaggcggtttgtggggaggcattcaacctgcccttgggaggagataatgaggtgcacccggtcatgggaatggggtggttagaaatgattacggtgcagtgaggaccaatcagcaggccgctacaagttctgtctgggactctgggttccaggtttcttcctaggggcatcacaccagcctctactgcaacagacaaaaggaaaaggcaacaagaatcacatctccatggtgacggtcacagagcctgatatacgctgccccaacactaggaaaggtctcccaaggcaggtcctgttcactgcagctggtgagtcagcagcccgcacccagcccctgcccagcctgcacacaggggttggacacgaacctgtcacgcaacattgcttcattcctcgagtcctgtgcacattcccatttagcaggcagcagctgtgtggctcacaccaaagtttgcaccgagaaaagcttccaaggctgccaccagggtctcaaaagagaaggtaaggctgtgcttatcctcccctgcaacctggtacctctggcctctgaccctggtgtccccacggccctctgagctatctaaaaaactggaatcatcttacagtgtttaaaaacctggttcaatttagttatcaagttggtactcaaaagatgagggctggctatcagtgagaaactggggcataatcgttacattcgctaacactgactgagtgccacttcatgcattaggtactcaacatttcaccttctccacaaccctcaaggcaggcatctatcctataaaggaggagaccaaggctcacgcaggttaagttgctgatccacagtcacaaagggaaaatatgttgaggccaggattcaaactaaggctatcagatttcaaatcccttgttctcaactcttcctccacagcacagggccacagccaaggagacagagacaatataagaccgggaaagtagaggagggtgtcaggaagaattcatggagcagacacgatgggatcatagactaagcagccctgggagatggccaggggtggcgggggggtcccccagggatcactgaaagggtaatgtaagaagaggaagctcagctaggagggtgaaaggccttaaaggtcagcctgagcttccacaggccatagggagtccgggagagaagcacagggagacagtgtgaactgcgctttagaaagaaaactgtggcattgctatttcccataaaaactcttacagatagaaaactagcagtgactggtcgcggtggctcacgcctgtaatcccaacactttgggaggccgaggtgggcagattacttgaggtcaggagttagagaccagcctggccaacaaggtgaaaccccgtctctactaaaaatacaaaagttagccaggcgtggtggcatgtgcctgtaatcccagctactcaggtggctgaggcaggaatatcgcttgaacccgggagatggaggttgcagtgagctgagatcgtgccattgcactccagcctgggcgacagagggagaccctgtctcaaaaacaacaacaacagcaacaaactagcagtgatgaaaagtacagagcaggtcagtaatacaaacagaaaccaaaagtttgctgagaacgggtgcttcccatcccaggctgcgagtctgagctccaagacatcagccgcgtcagtcttatcatccgactcccagatcatactccccaggacacggcaccaattatctcttccaattaaaccaccgccacaggatgctaaatccagtgatatgaaccggcagcaggatgcttgcccagcccagggctggcatttatgatccttattagcaggaaagctctgtcttctgctccccacggctcagctgtggaacctggagctcccaccagcccccacagcaggtgctctgggaaggggcagaagaaaatgatggcaggacttggagaagccaggacagcagagtcaacagttccaactccattggggaactttccccatcgatgacagcaatttccctaacatctaattataggcattttgtcagctaaataataagttgcatggattaaatgcctacagtgagccaggaactccaagaagtaccttgtgtaatttcatctaatcctcgcaacaaccctctgaggcaattcttcattgcccatcctcattttaaagatggggaaactgaggctaagagaaacctgccataggtgggtagacctaggactcaaagccaggtggtgtctagctccgaagtctgcacttcttccattacaccacagcagaccctgaaagtaacacacacggattttacaggatcccaaagtatcttcagggaggttttatttcccaagagggtccttggggcaggagggaaatgagttaatcatgagagctcacaagtgctgggcactcatgagccaggcctaggcctaagctctgtgtacacattcattcattcattcatcttcattctttcaacagccctgtgcataagcactatcatcacccccattttatagatgagaaaactaaggctcgaattaaggagattaagccacttaaagttacacagctaagaaattctggagctagatggccaggcgcggtggctcacacctgtaatcccagcactttgggaggctgaggcgggcggatcacaaggtcaggagatggagaccatgctggctaacacggtgaaacccagtctctactaaaaaaaatacaaaaaattagccaggtgtggtggcgggcacctgtagtcccagctacttgggaggctgaggcaggaaaatggcgttaacccagaggtggagcttgcagtgagccaagatcacgccactgcactccagcctgaatgactccgtctcaaaaaaaaaaaaaaaaaaaaagaaaagaaaaagaaaaaagaaattctggagctggatacttagctatagcggtacctaactctgaagcccgagatctgacctctccctaaaacagacctgaaacacgagttcccacatccctggttggtgagacagccaagtgcctccaacgttaagtggcctcctgtcctgctggaggctggacaggtagtttccatcgtaacacacagaggccacagcctgcctgaggggagggttctctctcccagacaccacaccacaaggccacccccctccatctgggaagaaccaggggcctttccaaagtgaatcatccgaataaccagtctttatcattttaactgtcatcttttaaaaacatatcacacacaccgtgcgttcttaaatggagctactgcccagtggctgctgactcatcaccctgtaaagaattgagtcgctgaggacagatgtggcaaggccaagccagctgcgtcagccccgcttgcttaatcctgtctgaagcttcttgaaatacttcacctgctccatggaatataattcatcttgtaaaattgcttaaaacttttagaccaaaggcatttacatttaattaaatgaccagggagagttaacttccctctacctcccctggaagaggtcaccttcagaagtgacctatttcctccctgagcccaaagaggttgtggaccctaaagggccccagtctaagcccaccccatgccactgggctgaatgggggccaccacatcttttggcaagccatccatcaacagagtcaccaacaggcaagcagcctgggctacccgagcagactgtcagccacatgggaggaaaggtgggggtggggtgggagcaggaacagaggggaggacctgaaagaggaggtggagaaaggctgggaggaagaagaggatgaaaaaggccacttgtgactcagggggcctatgggccagcagcaagatcatggagccccagcactgcctgacccactgcatcaccgcccacatttttaacaaggctccaggccattcacaggcactggacagtttgagaagcactggtctacagcacaggctttggagtcagaaacatccgggtaccagccccagccacactactcactttctatgtgacctacaatgagctacatagccccaacctgcctccactgtctcatttgtagggcagtacctacttacaaggtggttttaagaggaaattaaaataatgcaaataaagtacttagcacaaaatctaatacaaaaaaaatgaccagctggctctgctatcaacacataaagcttagaacccaagtcaccagattctgcctctcattacttctcatcattatggaaacctttggaggcctttggccatggcattctgaacctgcttggtatattgcaatgctgtgccacctaccagcatgttcctaaatacacatgtatttaaggcagcatcatcactgagataaaaagttaccaactacacctggagccagaaacatgtgtataagaaagggaaaataaggaggactgagagcacttgagcatttcattggcctgcaccctgaggattcgcccttgagcctgaaacatacacgcagcacagaggtcaaaggcaaagagtaaggaatcagcagctttgggaaggtggggcacggggacaggccaggtctcctggactcggattccaggcacgctgccacagctgggtgctcccgaggacagcacagacaaaggtcactaccttgacccaccaatctccctaatgacacaaaacgccctttacttccagagccagcaaacacagcaacctgatttcacaagacatgagcccttctggaccctaaagagtacgtccacgtgctaggaaaagacgagcgctacacgacagtcccgacactgctgcacagctcagaccctgtcctggcccgcaggccactgcctcctcagaactctccttttcctccatgctcccaggctttgttggtgacctcaccgtgcaccagaccttaactcctggtcaatgccaccctgcccctcatctcatcctgagtctgagcatctctggcactaaaatttctctgatcccctccatagtccactcacttcactcccaaagccaccattcaggttctgactatgaaagccctcgggcctgccagcttctgtctctccaattcaaactgcttttagcaccactgcttagccaacctcctacagcgggtctgatcccattgtgccttgggtggctctccactgcttacagaatcacacccacggccctccaaaggcagaggcagcaaagctcaggcttcccccactgcctgtccacccactcggctcttccactgcagctactggaataacagatctgagctttgggcctgctgctgatgatggtggttgtgtcatttggtttttaacagaaagcaaagagaaagaggagaaaagttaaggagcatccgggtgcagtggctcattcctgtaagcccaacactttgggaggccaagacaggagaatcgcttgagcccagcagtttgagaccagcctgggcaacatagcgagactccatcccttcaaaaaaatttaaataattagccaggtgtggtggtgcatgcctgtagtcccagctacttgggaggctgaggcaggaggatcccttgagcttaggagttcaaggattcagtgaactatgaccataaccactgcactctagcctaggaagcagagtgagactctgtctcaaaaaaaaaaaaaaaaaaaggtaaggaacaagtttctcaatcctgccttttattaacacatacataggtcagtaaaaaataagatgaggctgggcatggtggctcacacctataattccagtgctttgggaggccaaagcaggagaaatacttgcagccaggagttcgagacaagcctgggcaacatagtaagaccccacctctacaaaaaattaaaataaaaaattcaaaaaaaaatttaaagatagattttgctataacctggaaatttctccagccaaagggttgttgtcatctcaggcatcaatggcctcaataattgtattgttggtcaaaacctcttgggaactcatctttaagaacagcattcagaattaggttttgtttgtttgtttgtttgttttttgagatggagtctttctctgttgcccaggctggagtgcagttgcacaatctcagctcactgcaacctctgcctcctgagttcaagcgattcttctgcctcagccttccaagtagctgggactacaggtgtatgctaccgcatccagctaatttttgtatttttagtagagatggggttttgccatgttaaccaggctggtctcgaactcctgacctcaggtgatccacctgccttggcctcccaaagtggtgggattacaggcatgagccaccacacccggcctcaatcctgcctttcactaacccatacatatcatacataaggtcagtaaaaaataaggtggcgcggggcatggtagctcacatctacaattccagtgttttgggaggccaaagcaggaggaatgcttgaggccagaggttcgagaccagcctgggcaacatagtgagaccccatctgtataagaaattaaaattacaaaattaaaaaaaaatttttaaagatggattttgccacaacctggaaatttctccagccaaagggttgttgtcattttaggcatcaaaggccttaataattttatgtttggtcaaaacctcttgggaactcatctttaagaacagcattcagaattaggtttctaagtgactcaataaaaggagtccttgtccttcacaaactctcctgatcacatatagtattgagtggctttgtcacttgccttagtcttgggccttagctctgactcttattcctaaaaggaaaaattaagtccattctcagtaggtgaaaacctatcataggccgggcacagtgggtttacgcttgtaatccccgcactttgggaggtcgaggcgggtgggtcacttgaggtcaggagttcgagaccagcctggccaacatggtgaaaccccgtcactactaaaaatacaaaattatctgggtgtggtggcacacgcctgtaatcccagctactcgaggggctgagggaggagaatcacttgaacccaggaggcggaggttgcagtgagctgagatcacaccactgcacactccagcctgggcgacagagcaagatcctgtctcaaaaaaaaaaaaaccaacaacaacaaaaaaacccttcagtgccttctgaagtaatgtttgttgatcctagtaccgcctaaatttctgacggtggttctagaagtgctttcccaaaatgtttgagtaatggccacactgagagaacaggtagaattagcctccaaaggcaattcatataattacttctctcacacttcaagatatggtctggttcaaaatttatgtatcaaagtataaattcatcaaaatgtcaaacaatgacccactctaggtggcttcctttgagaccagtaggaaggataaaatatagaccagtccttatttatttatttatttttaattttttttttttttgagacagggtctcactctgttgccccagctggaggacagtgatgtaatcatggctgtcactgcagccacaacctcctgggcgcaagcaatcctcccacctgaaccttgcaagtagctgggactacaggcgcacaccatcatacctggctagtttttttttgttgttgttgttgttttgtagttttttttatagtttttttttgtagaaatgacatttcaccacattgcccaggctggtctcaaactcctcccactcaagtgatcctcctgccttggcctttcaaagtgctgggattatgggcgtgagctgcccagccaacaagtctttatttaaatgagagatataaaaagtcccaatttgccccatgtttccacatgcttttcttcttcatcctctcaaaccatactccataaatatttgtaaaaatgatttgattttggtctgtcaccaaggatacactcctcaccctaaggggttatgacaacagggaaatactcatctcatttttgtgatgggctgattagagccagaaaccttctgatttccttgatctaaatatttttccctcttgtagcttcaaaaaaaaaaaatgctagcaaatgcacagtccatgtccttggtattcaaagtgtgctccctgaatcagcagcagcagaatcacctgggagtgtgacggaaatgcagtgtcctggggacccatctgtgctggacttgctgaatcagaacctacatttgacaggatcccaagcaattcccatgcacattggagtttgggaagtgccgttctatgctgtgagtttaaaagacagcaaatgattttttaaaacattactagtcttaatgcactttttgttttgtacgaaataatgaactgtcctctgattctctgttcttatctacaaaaagaaatgactgtctattctccccaggttattgtaagagttaacgctcaatgcctagctcaaagcctggaacgttaaagctgcccaaacttccatttatttaccctccaaacatcacttccttcctctagctctttcttcctataagtaaagttctttcttgcttttagggtttaaaaaggtaagagaaggtaaaggaatagcatttcagagaaaaggaagaaagcaataaatacagggaacagagtcaaatgacaggaaactctagatcaccttagagaataaactcttaaagtcagcagtctgtacacagagaagctctggtttggtcatccttcaggtagcaggtgcaacagttagttgtagaaacatggatgtggttatctaattctgagaagactcaggacttcttcactgcaaagctcagcagagaaatctatgtcaacagagacatctgtaatgcttgacacatcccaggcaaatgccggaacgcctctgttcctataagatctcccatgcctccctacccagagcacagaaggtccttatcactcttggtctattctaatcagcagctttcaggttatctcccatctgccatgctaagttgcttgaggctaaggagagtagcttaatcatctttacactctccatagcactgcaagatctagtagacaacgggagctcaatcactggttgtgtgagtgtcctgagctgttattctctctgaagcaattgccctatttgtagatggaatcaactatattttatggctcccggattcccaattttattggattgctctcatgccttccatctagttgctaaacaaaacaacaagaaagcctacctgcctcaatattctcatttaggccaaataaactgccctgttacatacaccaagcacctgaacgagtctttaaggaagaacactcagctctctaacattaaaagacacaaaggcaggaaaaccaatacattcacactggagggtggagggtgcagggtgcattcgacaggctccttaggctaggagcgcagagtccaaagagcgcagccctgcctcagatatgggttcctgtgctggaacctcagctactaactttctccttcttctttgagatggagtctccctctgtcgcccaggctggagtgcagtggcacgatctccgctcactgcaacctctgcctcctaggttcaagcgattctcctgcctcagcctctggagtagctcggactacacttgtgtgccaccatgctcagctaattttttgtatttttagttgagatggggtttcaccatgttggccaggctggcctcgaactcctgacctcaagtgatccgcctgcctcggcctcccaaagtgctgggattacaggtgtgagtcactgcaccccgccaaagtttggtggcctttctctattttctaaatgtgtttgagactctaaatactaggaaaatgtaacagaggtcattaactgagggagcttacctccaaaacattttccaaagggcagagaacataacatgatcattctgacagctgtgacaaatgtgggtttatttgcctgactgcctctgtgtccatttatctatgatcactgaggcctcatactcctgctcaggaaatgtacccagctgtccacttagaggtacagctgaccaagagtctcaaagtcttccttgacaatccgaaagtacctaagcacccatcgccattggagagggtgcccttgaagggtaaccactttacatttggcacaaggacttcttggccccatcgggaccttgcacgatgacctttgatcctctgcagaggaaccaacagtcagcatttgctgcgggcaaggagccaatagcaactgactctgccgaaattatcctctcccaggtcttacttattaaattcagaagtgtccagctctgaactaagaggggattttcctctggcatccataaagatggctacggaaggaattaattttcaatcttttgctgtgtgccctatatcttacatgttcccttatttaatagcatgatcacccagggagttggacgtgtaccctaaaagatgaggaaacgcagccctgcctaagaccacaaaagaagcacctggctccagaactgtcagatcctgaagcatccgtgttggttcatgcttttctagagccatcctactccctcaatatgaagagctcaaataagatggctagactttaaagtgaacttatttattcattcaaccttattcggtgaaagggaccaggaaaatggagtggtaactagagagggagacagagtcaggggagttttgggatggtgacattaaagtgatgcacactcatggccaatctagagtgaggaatatacaggagagaaacctgagcagcatggggtgggggctgagaccccagaaggcccttctcccacaggaaaggggaagccagacccacggctccaacatgggcaggctggtggtaagctgggtatctggtgttgggaagatgggtgctgaacacttgcagaaagcaggagggagggggttagatcactcgcaaaaccttggccttggcccagctgctgtttcatgctggggcctacaggaaacaggtggtcacctcctccgttcacaccctagaaggggtggaatttatgtgtcacatttgggtctcagattctccccccaaagcagcatgcttccgacgggtgtctaagtgagggggggtaatcttcccccacaagctaaacagctgttttttgtggttatattttggatgtatacacttgctcattcgttcattctgtgcaaacgtttactgagcccaggtgtaaaagttgctatgggaacatgaaaataaatcaggctgaacttgccctcaaagaacatatcctcttatagaagacttacacacaagttagataaattaaggaggttaagcagggtttggcagtttagggggagtagattaattccagctgggagcagcgtagtacttcccaaactttaatgtatagaagaatcacctgagacatttcccctatggggtctctttctccccataaaattctgttattcctggatctttttagagcagaagacaatgactttgctgatggtatagtcctatgagttgaagaatgtggcctttaacaataaatctaacaaagatgttaatcagaattatttcaccttatcacagagatccaaggaaatttcaaatttcacaactacaaaaggcttaaagtcaggaaactgcagttcaattgttaagcgtctctctcttcaacccatggagctaagaaggtacacatcagtgtttgtgatcaaatccactaccccaaactgggcctatcttagagtttagtaatgttgataagtggcgcttcaaaggaagcccacatcatcctaaaataagctgggaatgagaaaagtcccagctgaaacaggaaggggatcacacacagacattccatttccaaatttccttccccggcggagatccgtgcccttcggtacagtgtcaggaaaccggagggtctgtgatgagataagcagacacctgctctccccacattcttggagctactcagttctccccggagaatagaaatgggccacagagctcattaccaccattcaagcatgaagctgaaatatctcccatttaataacctaggggtcttcagagtaacacccatcacagacgcatttcccacctctttgtccaggatgcaggagggtaacaagggccctgaggccacaaaagaatgaggagcagaggaggaggcttttcttaatcactagtaattatcactatcatgttacaagcaaacaaatatcattttggaaatccagaacaatctccatgaggtaaagaattttaactaactgggcgggccagtttgaattcatcaaaaggctgaactggcaagcacttactacacattgtcacaacaaaaaagtaattttattttttcaaatgcgtatgtagcaaggggctaaattaaaaaggtattggcggcctggcccaggtggtggctcatgcctgtaatctcagcactttgggaggccaaggcaggcggatcactagaggtcaggagttccagaccagcctggccaacatggtgaaaccccatctctactaaaaatacaaaaattagccgggctttggtggcgcacacctgtagtctgagttactcgggaggctgcggcaggagaatcgcttgaacccaggaggcagaggttgcagtgagccaagatcacgccactgcactctagcctgcgccacaaagcaagactccatctccaaaaaacaaaagtgttgccttaataagatgtaaaattatcacaacaaaacaaaaatttaagtggttcctataaagtgctataagaatatattctattaaatacactattatatctttctgatggtattaccttacttagattttttttttccctgagacagggtcttgttctgtgtcactcaggctggagtgcagtagcactatcttggctcactcccgtattcaagtgattctcgtgcctcagcctccggagtagctgggattacaggctgtgccaccatgcccagctaattttttgtatttttagtagagatggggtttttccatgttgcccaggctggttttgaactcctgacctcaagtgatctgcctgcttcgacctcccaaagtgctgggattacaggcgtgagccaccgcgcccagccccagatttcttttctatgtagtgctatgactattactaactaaatgttcatcatctgcaaagcctaacctttcgttcaatttcttgccccaatagctaataatcataatagtgaataaggtaaacattataagtaggcagaacaatataaacagtttatgacatttggctgacattataagtaggcagaacaatataaacagtttatgacttgtggctgacatttaacgagcacctactatgtgaaaggtgctttcatccagactataggtatttattccctggatcctccccagctgcagtgctggacagttgtccatctcattttacattttacagaggaggaaactgaatgtctggcctcccctaggcctcaccagctggtagatgggtcaagctgggatacaaacccagccttcttgattaccctacccactgttatttcactgagccaaggctgagaaacgcagtcactctggttctacggaagagctgccttctctgatgtgatggttgttcgattattttaaaaagtcggggtaggaaaggactaaaaaattatacgcacacaccttaaacaatttactggaacggaaaacattcattcctcaatcttgtgaagggccaaggccttctctttagagtggggatctgctgactagagttctgtggtctttccggcaacaaccacaccccatccacacaccctgcaatgtcagatttcaggttccttcaaggagagtttcactacttacaaagtagaaaatccttctagatttttttgttttgttttgtttttgagatggagactcgctctgtcacccaggctggagtgcaatggcgtgatctcagctcactgcaacctccgccttctgggttcaagctattctcttgcctcagcctcctgagtagctgggactacaggtgcccgcccccatgcccggctaatttttgtatttttagtagagatggggtttcaccatgttggccaggttggtctcaatctcttgacctcgtgatccaccctcctcggcctcccaaagtcctgagataacaggcgtgagccaccgtgcccggcctcaacccttctagattttacctacaccatcccctctttatttatactgattgtctcaaccacaccttaaacaacaggaatttctttataagttgttttgcaactctttccaaaacacataacttagttttcaaaaaaacgagttctcttttcacactaatatgtcatccgtgtatgtactattttggttacataattacaaaagcaagtacatgtggcaaaaaaaaaaaaacaagtctgggggaaaacccgcaactgatcagtaagcacagagctcatctgggggaggggacatggcaggggacaaggaagagagccatcacagcccccagtgccctgatgggtcaaatggaccaggggaatggaagaccacagtcactttggccagcaggcccagtgcaggctggttaagagagctccctccagaccccccaatccccatatacctgtgagcaacttgggaaaacagtgaacattcctatcagaaaataaagccgtgttagagaaaagaataaaaggattgagacacaattaagatgggttcaaataaccacaagtcttttctagtcccagggtctctctgagcctcaattcctttgtttgaaacgtacagttaaaacaagattccttgtgcagttgctgcaggaattaaataagaacatatggaaagtgcccagcccaggccttggaacacagaaattactcaataaacgggctctttacctgatttatcgtggtatctctctcccacagtgcctagcaacatgctgtgaagtaagaagctctgatggctggacagaaagacggacagatggtctgatgtcagaactgtaaaaatccttcagtttatcaccttgcttggctcaaatggcccccctaaaacaaatcaagtatctgtagctggagtcagagtgttccccacctgaaaataaattctaattttaccaataagcatggagagaccagagtaggaataaaaggaagagataaacagaagagaatttaaaaagtatcagacccagatgttaaacaaaaaactggctcactggcagataaatcttttttcccctcttcccgccaattgtggttattaagaatgaggacacattagaataagtgtgattttttttcaaggcacagagaaatttatagacagctaaatccagcaaaaagataaatcatttacccttagttttcagtaaatagaaagtctccaaaagttgaaaggaaaacagttccagaataaccaccatgtggttttggtttcaagtacttagcatttcataacaggcgcagttcactgagaagatatttaaactctgaaacgaggcaggtgcagaatacatgctttcaattgtggatgtgataggaatggaaagtaggcagaaattgaaggctttttttaatttaacgaatcaatcagcagataaagctttcactcactgtaaattttctgtttacaaaagctccacatgctaggatgacacacccaaagactagggaggggacactatactgtggaaagaaaaacatctccattttcaacagaaggagcccaaagtcagcctaccctttgaagtttcagttagctcccatcttcctgccaatcacccaccttaagtccaaggaggctttacaactattagatctctaggcatctccttagctagtaacatatttatattgatccacctaagttggaaatatgagttgttaagacagccccatgtttcttctgggttttttcttttttcttttttcttttttttggagatgagtttcactcttgttgcccagtctgcattgcaatggcatgatctcggctcactgcaacctctgcctcccgggttcaagtgattctcagggctcagactctcaagtagctgagattacaggtgcatgccaccacgcctggctaatttttgtgtttttagtagagacagggtttagtcatattggtcagtctggtctcgaactcctgacctcaggtgacgtgcctgcctcagcctcccaaagtgctgggattacaggcatgagccactgcgcccggctcttctgggttcttaagcacggtgttaaacctcagttttctcatctgtgaaacaggagcaatgaaacctacttgagccagccattgtgagaactaacaataacagacttagcacatacaataagttctcaatccatggtagctgctattcttctttttctctgcataattaagggggaaaactgagtatctttgatcaataaaatttggcagagagaaaaaaattggtaacccctagtgttaataagacttccaaagaagcatttggcaatacaacagaagcctacaaatgcttacggccctcactcggcaatcccacatgaggactccatcctagggaaataagatatgcaaaaagatgcacaggaatgccttctgcagcatcatttagaatactggaactctacaagcaaaagataaccaacagtgggggaaatggccaaataaacagttgtgtgttcataggagttgttcctgcagccacggaaaaatgattacaatatgatcatttaaaaacaaaaatctagcccggcgcagtggctcatgcctgtaatcccagcactttgggaggccgaggcaggcagatcacctgaggtcaggagttcgaaaccagcctgaccaacatggagaaaccccatctctaccaaaaataaaaaaattagccaggcgtggtggcacatacctgtaatcccagctactcgggaggctgcagcaggagaatcgcttgaactggggaggcagaggctgtggtgagccaagatcgcaccattgcactccaccctgggcaacaagagcgaaattccgtctcaaaaaaaaaaaaaaaaaaaaaaaaccacgaaaatctgtactcaaaactttgggatttcatgttataaatatatttaaaatagtatgtacccattgtgtctataaatattaggagaaaagtacaacaaaatactacattaggtatttccaaatggcaaaattacaggtaacttttatatgttgtcagagaattgtttgtatttttgaaattctgtgcaagtaatttatttaaagtcaggaaaaagttattaaaaagtttgtgggtgtgggtatgtgtctgtgatggagagggacaaagcacactaaagagaagccaactggaagcacgccattaattgctgatgcttgagtacagaaagaagagaaagaataggattccctttaggcccacggtttgagttacattaagcctgtggtcatttcctttaagacctgggaacatgggcattgctcattttcatgtactattatttgtgccaaaagaaaaaaaagaaagcctcccaaacctcaaaccacattgaaatgcatgagcagcacataattctgtagcattttggtttccttggcaaccttatctctgtcttctttgatctcaaccacagatgaaaaagtcttggttctccaaagtccctgagatcaattgccagctagacagtagcagaacatggtagaatgctcattctctaagaaagaatttctaattaatgagtttcttcacaccaagctcattccacaatggattttagagaacagattcttgatgcatttaccatttgagttctgagctgtctgattttcatattaccacaatttaattttagcatcacgtaaacataattaatcttttcaccaagtgaatgaaacaaggaaattacatttaagcctccaattttgctaaatagtactggtgtctaaatatttacctgctctctccacttcaggtcccttgagcaggacgtggtggggtttccaggcctaaatctaacctgcaaatgtcaaactggaaaacactgctacagaggctgtgagcaaagccctgaggtctgaatactattggcagaatgttatgaagaaatcaggagataattccaaatggacatggagaaacctaagtcatccgattatgattcagtataagagggcttaaaacattttatggaatttgtgtccaccccttaagtcatttttctaagaaaatgtctagctggataaactgaatgaaattaggtatgtcatacacagattcattgagccataaacgtttactgggggcctactatatatgtggcattgataggtcttgaggcccaaatgtagagaaggacatttctgttcaaacacctgaaccagagaccctctcaaaatagtgcatcaaaaatgcatttttcagccaggtgcagtggctcacacctataatcccagcactttgggaggctgaggtgagaggatcacttgaggccaagaggttgagactagcccggaaaacatggagagaccctagtctctacaaaaaacaaaaacaaaaacgaaaaaacgaaaaacaattagccagcatggtggcgtgcacctgtagtcctagtagctactcgggaggctgaggcgggaggactgtttgagcccaagaggttgcagtgagctatgattgcgctactcattccagcctgggcaacagagcaagaccttgtcaccaatttttaaaagaaaatacaattttcaatgtgtagaagaaaatataaggctccaatgaatgttgggtggctagtcccatcttcacgatccctatcaatggcaaaaatcttaggataaactcaaattattcttcccacgagaatccaaaggacgctgatttgagaacagctatgcggatatgtttccgctggggtatcacaagcttaaagcacaccagtttaccaagcttttctcttttttctgttctttgaactactgtccccaaatctcattttctcggttgacgctcagcatgattttcaattttaagctccaacctttgacttaaaccctttatcatgcgtatccagaaagcaaaaaggatcataagcatcttactattttgagtactctaagctgttaatgaaagtatttgcccatgttcccaaagagacaaaaccctcgcccagcttcctcggcttaagtggtgacagcaacaatctttgctctttcagggcacgaaggtctctcacccgatttcaaagaaactatgatatcttccttcagaagctgctcatgcaaatgaattctagttattcctgctgtatttctcccctcctttccactgtgaatgtctatttagaaaaaagtatgtaaaataaaacacactttaaaaacacttaatggacagtgagggttttaaaaaattgtattcaactcattttttaaaggcattcctgggccacgctgaaacctcaacttgtctaggctcctttgggaaaccaggaatcaaattcctttgtgttttcttctgtccatctcactggaatattagcaaggctgggattataaatgggattataagccttagtcttttatttcaatggctgtgccatctcatctttagccagttacatactgaacacttcacaatcgggagaacatgtaataatgaatataactgccatctaatcagcatctcttggtaaataaatgaccatagagtcatttatttaccattcattcatttaaaaaatctaaaaatattttcctgggtcacaaagaataactgagtcttgctgcttctcaaattatctttagataaggcatctcttacacttctactgacttttaaaagcaagttatatccacagtttcataatttagacaacttgtaagaaatgcaatagcaagatccctagaaacttaaactattactgagaagacagaagaatttggatgtgatgaaagcagggtttctcaagtgctttaaaagacaaaatgcccgtgagttttaaaccatccacagagaacagagccattagaaagctactgcttaatatcttgaaggaaaatttgtatcacctatttttcactaaataaacatgttgtataacctgcagctaaaagctattttcctcatggttaaaaaaaaaaaatctgcaccattacatctttctctctctctctctctgacagtcttcctctgtcacccaggctggagtacactggctctaccatggctcactgcagcctcgaactctggcctcaaatggtcctcccatcgaactctggcctcaaatggtcctcccacctcagcctcctgagtagctgggactacaggcatgtgccaccatacccagctaatttttaaattttccttttgtagagatggggtctcactatgttgaccaggctgctttcaaactcctaggctcaagtgatcctcccgcctcagcttcccaaagttctgggattacaagcatgagccaccacgcagtcattcctctttaaataaaaggaatttacctacattttcaaaaactacttcaaagtacattttcatactatttatgtcttatgtatgtgctgagtaattcatgtttggatacatctagatttagagtttttttatgaaatacgattcttttgggtggaatttgttagatatcaaagtttcttttttccccttagctttattaagggtatagctgagaaattaaaattgttatgtgttaacagtatacatgctatgttttgatgaatgtatatgttgtaaaacgactaagatattttttgtagtgagagcatttaagatctaatctcttagagattttcaagtcttcttattaaccacagtcaccatgctatacaatagatctccacaacttattcatcctaaaactttgtacttttagctaacaacagtgtttatcctcaataaagcatgttctaatataaaaaaaaagatgtgtggcatgttgaaatattactatttcttccatcatgttttagctcatttcaaaagaattaaatcatttctcacttcttcaattgttacagctcgtcagctataaaaataagcaaggcaattcaagttccttgaaatacctgaatgactatatagacgtatccttgataacaggacacaggatcaaggtataagtcatgtgcattaaaatccagaactctctaaaatcagaggccgaacaagaacctctggagccacctacaggtccccatgggctgtgtgatccaacccatcaccaacagtggggtcatgtcctgagagaactcaatcttaaaaacaaatgtctccaatcaacctagcgtttcaagagtagcaaggggaatacagtttaccagcaggcctaaagcagatttagcctctatagcctctgcaatcctatttatggtgggcatggaccatcagcttctttattaatgtctgaaatcaagaggtggcaagactcaccccatcccagcatttcaaagccttttattaacagaggaaaaaactggggcaaaagaataccaaggagctaccagagttgctccaaagattatgagttgatgttcagaagcagatgagtgatccggtgaaagggtttgttgttactattacctagtgtttttgaatttttttttttaagtatttcaacacaccaacaatggactctttgggtgcagtttaactttagctctcttctgttacaaaagttttgggtgggctacaaaataaggagttgcttaagaaaacctcacatcctccaagcagcaccacatcaacaatgaatttcgtctcactggaagctcactttgccctctctcccctaactcctcaggcccccaaagcagcccatcacagctccttagtagagggataaagccagcatttgtaaaagggagccctatttcccagagatatattaccttggaaaggcttgggggtctccacatcaaagttggtgggaagcacagtgactccaagaaagtccagccgtttccctactctctcctctcaggctcaggattataggaagagtcttcatcccaaatagcagcccccccccagatactgaccagacggtgttccaaggaaaggtaagtgagaaaatgtgagaatccaaggccatggggactgctgtgagatggacaccacaaggccatcagtacgccatgatgaaaatgccatctttatccaatgcccactgggcccaggtctgcactcatcgagtactatggggtccacccgggactaccctcaaggagctctacaacatccagcctctatgagacatactccaagtaggaatggatccagattaatcttctccaaaacagagagtttccctttctatctgttgtgggcaacctgccatccttcataaactttccaaaaataatagtattaacaataaccatttccatttagaccaaaccctaaatcaagagctggcaaactatggcagcaggccaaatccggcccactgcctgtttctgtaagtaaagttttattgaaagacagccagggccatctgtttatctattatctagggctgcttttgctctacaatgggagtgttgagtggttgtgagagagacggtagtctgcaaagcctaaaatattgactgtgtggcctttcacagtaaaagttttccctgtgtggtacaaagcatggaaacctctaaggagaggtgtccatcattatcagcaggaagcagcccttccctgaacaaacccccagcacagagcagcgatggagtcgggggcgctgagatgggagctatgcttcctgaccagctttcgtgacaatcacatgaccctggcgagccttggcacctctggctatacaattcaggcatcaatacctacttcacaaggctgtcttgagggtcagccaagacagagtacacaaaaagctcccggcacaggcaaattactcctcaaggtgctccattaatggtaatgaccctactgaccactgttactcaagaaagaacacaggactaatgtgaatccctgcaatactcatcttcagtcattaaggttcctactgctatgacctcgaaaagatcatagactcagcacgacaaccaaaagaaaggacgcaaggctctctctgtgttgagtcatagaaaggcacaaggtcaggacttaatgttcttgtgcttggggaaaaacactgagctgtttcaggttggaatctttcaattatcaaacttacggcagcctcctagatatggaaaagactaagagcattgtcacccagggtctgtctccgaacattgtatctttcatccttttaacagacagcaattggtacaaggtattcccagacagtggccaaactacacacaggccaacagaagcgctgaagagcctttttttttttttccctcgagatggagtcttgctctgtcacccaggctggagtgcagtggtgcaatttcggctcactgcaacctccgcctcccagattcaagcaattctcctgcctcagcctcccgagtacctgggattacaggtatgcaccaccacgcccagctaatttttgtatttttagtagagatggggtttcaccatgttggccagattggtctcgaattcctgacctcatgatctgcttgcctcggcctcccaaagtgctgggattgcaggcgtgagccaccgcgcccagccaaagagcttatgttttaaagggctgtgaaaccacactcctgttgcttcaactgacttgacacccacatatgctaggtgtgacttcagtcagaacacacaggatggacaagaatgagatcatccatatatggcgcagggcagggacctgacacaaccaaatcctgagaacgtgctaagatagagaagccgcgtttcctcgcccttctctccgatccttccatttttaccccatctcccctgacatttgcaaatggaagctatgcatagcctttgatcaacccagccttctgccatgcacgaacatcacattttcctgcattaatgcaactgatcctaacaaacaaatcttagcaggtgcgcagggcagggtttgggtgctggttttacggttggggaaactgaagctgagaatgatggtatggcttggcaagcaaggatcggagctatctgacttatccactgctccagagccatccccagggcccagtaagtacttggtagttaacacaaatgctcgattaacaatggtgtatggcccggattcaaatttcaactcctccacctagtagctgttgaccttgaggacatcagtttacctctctgtgcccaagctcatttatctgtgaaatggaaataataaactatcatacaaagttgtgagacctaaataacttaatatatttaaagtgcttacaacagtgtgcttggcacaaagcaagtgttcattaaatgttgacttctattacttgctgaatcaaatctacctgacttccacccaaagcttcaggccactttttgtcttctcgtgtgtactgtcgttctttaaacatgcattacagcaatttaaaaaattatgacctaagaaaggccacctcctaggatttcagtattaaagccccatgcaacaatgacatttttcaaaaagacttctggtttcagctgataacataccacaaagtatgctgatagcaccaggcagtcacgtgtggcagttcaagaacttgagcgtgacatgccgtgtgaagagcatgctttgacatacacagcacacacagcacaatcatataaattgtattttactgctctacctacctatggctaccaaatacagtccacatggtctttttttttttggtggggggggaggggcatagattactacagttagaaacatgttacattcagaaccatttccctagcttagccctctaaataaaggctggggacaattcctgactgcagaagggcccttccctgaaaccacagaccagataaagagctatgtgaaagcatttgcaagaaaagcagttatttcggttttcctgggacataagtctccacccagtcagacagtaccagccatggagaaaaagaccctccctgaagaactcgctaattcatctgaggggctcagagacagaaaaattcactgagcctgggttaccctgatccccagactcgaggacccagtgacatcctgtttttgctgggttctctctttcatatctcagagctgccaggcgtgctcccctagaagaaggcttttgggtcctctcccagaccccagggttccttagaggcaggggtgggccagtccttgtctgtcagaaagcccggttgtgtcaattttcttctccctaaaggattttcagtctccaacttcaaaactcagttccaaggccacctctcccctcggaaaccttctcctggctagattcacccatttcaaccaccccaggggttcccttctcctaatcctccctgtttagtaagaatcataagctgtttaataattggatgggactcggtaaacatttattccaacttcttagccagtagagaaatgtcttctttatttattttgagagggagtcttgctctgttgcccaggctggagtgcaatggcacaatcttggctcactgcaacctctgcctcccaggttcaagtgattctcctgcctcagcctcccgagtagctgggactacaggtgcatgccaccatgcctggctaattttttgtagagacagggtttcaccatgttggccaggctggtctcaaactcctgacctcaggtgagccatctgcctcagcctcccaaagtgctaggattacaggaatgagccaccatgcccagccgaggaatgtcttctatacattaacaatacccaacagaaatacaaaacaagccacaatgtaagccacatgagtcgtttaaaaatttctaaaggccacagtcacgtaaaaagaaacaggtgaagatttggagaccagcctggccgacctggtgaaaccccgtctctactaaaaatataaaaattatctgggcatggtggcaggtgcctataatcccagttacttgggaggctgaggcaggagaatcacttgaacccgggaagcggaggtttcagtgagccgagatcgtgccattgcactccagcctgggcgacagagcgagactccgtctcaaaaaaaaaaaaaaaaaaacacagccatcaagagcaactctaaagagtgatcccactgagtctgctttaacgaatatccacctaaaatgctctgaagttcttttttcattaacctatcatcaacccgtgaaaggttatcatcacctctgtgatcttatttacactgcgacttgatggcagtgaattctctgcctcacctgcattccaagttatctgtctattgcagcgtgactttcaaaggcaactgatgatttaaatcccaaacatattcacttccgtggccagacacttgggggttggcctggaatgcccggatggggcacaggagctaggcagatgggaaagaaactgaggaaggaattcagaaagatgaatctgattttaaaagcccagaccaaccaattcctgtgccaacaagagggtagtgtggcagccctctgaggggtgacaattggttggggacagtacaggaagtcatcagctcaaagttatgcctaaatgcagtgtgtggtttagtccatcacattgaaataaaatagttagctaataacttttcatatgttatgtcttctgtaacattttattcattacaactatgttggcatatcaccagagaaaagatcatatttgctaacttataaaaaacaagccgggcatggtggctcacacctgtaatcccagcactttgggaggccaaggcgggtggatcacctgaagccaggaattcgagaccagcctgaccaacatggtgaaaccccatctctactaaaaatacaaaaattagctgggcatggtggcatgtgtctgtaatcccagctacttgggaggctgaggcaggagaatcgcttgaacctgggaggctgaggttgcagtgagccgagatcgcgccagtgcgctccagcctgggcaacagagcaagactccatctcaaaacaaaacaaaacaaaacaaacacaaaaaaataaaacagggattcataacatttactttgcataaaaatatctcccttttccccctaggatatacaagcatgtgtgactttccttgaggctgctgggagatgcctataatcgacagaactactagacacaaatcgcattcaacagatgccggaaactttaactcactgatcccctccatgcccatcaggaagcggttagacatcctggttgcaggaaaaggcctccttcctatcacagacttccatcacagagaagttacagaacagccacttcttgggttacttacattccagagctcctgctagacggatgcttctggaaacgtcttactgctaccccacacgagggtaatgaggtgtatcatcgtcgctgacctgtagctgtgggaggagcaagttcctcaagcctcgactccaaagaaaggagggacaggcctgaagcgctcctgatggtagctgctgatacaatcctgaaggttagaatatttgctaaatgaattattaacctacagttaaatgtttcaccgtcttcgctcatccagtgttcattttaatgacacagatcattagcaaagaaacaattccctggcacgcaaagcatcacagaagcacatgttcccatccactctctccacctctgtcactttccacggtgagaggactttctgaaaatgtgaggcatattaacgagttctatagcagagaagttcttcctccctcctcaaagatcaggagaaatgatcaatcaaaattctggagaattttaagaaaaacaagagtttcatgaagtataaacattgaaaggttcatactagaccacatgaagtatgatgtatatccttatgccaagaacaccaggaagtcaccaacactgatcctaacccagcgtaattgctactagaaggtgaccttggccagctgcgtacatttccaggtctcaaccacgttaccaacaagggagggtgtaactcacatgactatctgacaagcataatgtaatgtacccattagtaaacgttacaagcaacgtgcacagccctttaaaatttccttacattcctcatcagccctatgaagtatcttctgtctactttagcaaagaaccacctgaggttcagataatttcaataacttgcccaaggccacaaagttagaaagtaacacaatagggtactgggctctagttttccaatgccgaaacttctaactaatttaataatttaataatattgctttaatatcaaaggcactctattcttaatcataaaaccactgcccaaatgaagcacttttccaccctctcttttctgctctctagccccctaaacagcagagcagaacacggattggaaaatgatgtacagatgagagttttgataactgcagatgccctgtggctgcaactgctgtcggggctcaggcccacgcttggggacctgctgggcaggcctgccaggagccctgcctggtgcacacaccaagtctgctgaccctcccaggggagcttttgttctcaaagtcattgcaaataactctaagaaacaacacattagatgctgactctgttgcaacagttagtggtcaaagacaatgtacttctggcatctttggtttagacttccccttgctaggcctggaggtacacggggttcccaagagcacagagagtcagatacgcccttcctcatcccagcagaacagggaggggttgccacagtggcctccacacaggtgagagtgatcagaatccatacgactcaacaaatagtcatctggcaccacgccatgcgcaggagcccggacttgctctgcaaaagtcaaagataaagatgaaagctttctgtctttttaccactagctgcctgggagataaatactcttacagccacacccataatacaagttggagagagatgtgtgcaatgacagtggcacatataaagcactgtggaactactgaacccaagcaataggctgcttactgattggggagagaaagagggatgggaggatgtgggagaaagggtagcatctcagctggtccttgaagcatcagacagagatcagagggaaccacattccaagagggaaactgtagacaaaggccatagtaaagtaaagagtgtgttcctaggatagtgtgtccagagttcaggggaacagaagctggaaagatgtgtgtataacaaacgctgaaatgctcaaagaagaaaacctacttaggaggttgaactttggtaggcagaagaaaataaaatctttgaacttggaatgatataatcagaaggagaaaaaaacctaatgtgtcttgagcattgaatctgactgtgttaagtccttttcatgcactattgaatttcctatctcctttatcttaagagatagatccccgtttttcaggagaagaaactcagactcactaacttgtccaacattacacagcttaagtagtggggctagcatacttgaactcaaaaccaactctttcctttaggaagagaaaatcagctatggaataaaggctgaactggcaaggaggacaggtgtagagctagggagaccagcttgcaaaataaagttcttaagagagctaaatgagcctaaatccattcataggaggaaaacaagcacacaaaagtgtcaaggcatttgagtaaaaagtacgatctctctaaattgctaccaaaaggacaatgagccaggacctttttttttttttttaaatgaaaatgaaggctgggcacagtggctcacgcctgtaatcccagcactttgggaagctatgacaggcagatcacttgaggtcaggagttcaagaccagcctggccaacatggtgaaaccctgtctctactaaaaatattaatacaaaaattagccaggtgtggtggtgaatgcctgcagtcccaactactcaggaggctgaggcaggagaattgcttgaacccaggtggtagaggttgcagtgagccaaggtcacaccactgcattccaggctgggcaaaagagtgagtgagactccatctcaaaaaaaaaaaaaaaaaagaaaaaagaaaaaaaggaaaaaaaaatggagttgctccttcagagccacccctgaagtattccaactgcaggcaacatggggatagaggaagctgttaaatgatactatgagagtacaaccaaccaagtccagaatgcagaaaattctacaggacaaaggaccagtaaatggcatttttacgaaaacaggaaggctgtaataaattagactaaattaaaggaacatatgaactaaatgcaagacatttgagtcaactgggaaaatggaatctagactaatgatgtgaatgaatgattgttaattttgttagaagtggtaatggtattgtggttatgggttggtcttgttgttgtttttaggcctaatctattagcagagtccatgcatccacgtatatgggtgaaatactaaatgcctgcactttgctttacaatactgcaggacacaaaaaggggttgggctggggggcaacatgtctgaaaataagaacagcagaaagttgatggttactgaagctgcgtaatggggtaagtgggggttcatcatagtattgtcttttttgtgtgtgtgtttaaaacttcccataataaagtgttgaaaatgaagccacaaaacatggaatggaaagttttttccttttttctcaacacatgtgttattaaaggcagagtcagcaaaaaaaaaaaaaaaagaagaggacacacactacttagtcacatatgggtgtgaacagaagttactttcctctgcactgagcagaaatagagggcatgacatgaagactcaccagcaacactgtgacagagacggttctggggtcagctccaagcccactgcgcatacatcatggacaagagcacgttcacacggtccttaccaagtccaaatttaaccaggatacagggaccttctgatgatacacagtgcccccaggcacctacctccctacaaaaagcatgaggctctcagctcacatacccattattggcccatttcaagctgttaaattacagcaagctttataaaatgaagtcccattccatctactgtggactaagtgtttgtgtcctcccccaaaattctcatgttgaaatcctaatctccactgtgatggtatttagaggtgagcctttgggaggtaattaggtcatgagagtggaaccttcacaaatgggattagtgcacttataagaaaagacatgagaatgatgatctctccctccaccacgtgaggatatagcaagaaagcagctgtctacaaaccaggaagagggccctcaccaggagccaaatgaaacagtgtattagtctgttctcacactgctataaagaaatacttgagactgggtgatatgatttggctccatccccgcccaaatctcatcttgaattgtagctctcataattcccatgtattgtgggaaggaccaggtgggaggtaactgaatcatgggggtggtttcccctatactgttatcacgatagtgaataagactcatgaggtctgatgttttgatatggggtttccgttctcgcttggctctcattctctcttgcctgccaccatgtaagaagtgcctttcatcttctaccatgattgtgaggcctccccagccacgtggaactgagtccattaaacctctttttctttataaattacccaatctcgggtatgtcttttatcagcagcatgaaaatggactaacacattggataatttataaagaaaagaggtttaattgtgcagttccacaggctgtacaggaagcacggcagcttctgcttctggggaggtctcagggaatgtttactcatggcagaatgcaaagagggagctaggagcttcacatggctgaagcaggagggagagacagaagggggaggtgccacacacttctaaacaaccagagctcctgagaactcactcaccatcaaccagaacagcagcaaagcgccaagggggaaatccacccccacagtccaatcacctctcaccaggccccatctccaacactggggattacaattcaacatgagatttgggcagggacacagatccagatcatattagccagcacctcgatcttggacttcccagcctccaaagttgtgagaagtaaatttctgttgtttgcaccatccaggctacgggcttttcttttaggagcctcaactaattttcattttataaagcttgctgtaatctttgcattatttcaaatgaatctgaacaaaccccagcaattttgaactttgttttagaggatacctcttaatattaacctgccaactgaactcagtaagcaattcctttacaagaactcaacactagttaagaacctgagatataaccagaatcatggatgattcgatgaaatgaataatgcacaataaaaagtgcattattaaagtacccttctgccctgtttagaagaatgaggggactttaaataattaaataataatagctaaatggtatcaattaccatagtaatttaacagttcacattctgtgtatctgagaatttatagtttattaagtttttctccatgacactcaatctatttctgtgacttgcatctcgggaatcatgtgtatatagggtatgcctttagctgataatatttaggaaggtcgccctttaaagtgaaacacttagattgaaacacatgaatggccactctagtctaattccagaaaagctacctaaaaatcacatggcgctgctcagctcatttctcaggagattaaaggctaagaattatgatttggctcctactggcaagcagctaatacatttaaactgtactggtcccactggttaaattttaaagtcctcagaaattcttaggaggaaacagaccagatatgattgttgtcacatccaaggggaccatgtaatgtgcctagcattcatcctggattctctactcaagtgcattgatgggacaacacctgggccgctccgctcccacctgggtaacatgaagatagcaacaaatgcagtggctatttctaagaagcaattacttcaggcagtgagggctatcccaacccagaattagagtccaaatacaacaactaaatagaaataaatacatgcacacaaaatggtaaggaatcatctcttcctgactctctctcttactcctaaaaccagaccttgtgattcagttcccatggaacttgaacttgaataagagccatagagtattagaagcagtctcttttcacatactgaaaagtaccaccccccagaaacatggcaggtaggatggccactctgagtagatctcaaagccacacagctgtcccgaggatatgcttggacttcaagacagtacacatgtgtacatttcagaaatgaaccttcaaaagcccttctctggctctgagctcaattgtaggagatgaaaaagcattcggcagcccagagttaggaatcagaaaagcacaaacaaccgtttgagtgatctggaataggctgtgccacagaaacaggggcccttcgaaagaagcagcactttaaccaaaagaaagtaaacaagggagggtgggggcaaggaacgaatggcactagtttataattagaatgtatattttggtatttagaaagttgcccatgcgcatgcacacacacacacacacacacacacacacacacacacacaccctcaagctgaagggtggaggcaagatcaaggggataaatcaacaaggcttcccacacaacagcacagatcactaacccacgcctccaacagaagaggaagttccttgtttagagcattaaccctccctcccacttgctggggctgagatgcctcccactacacaccaaatatgaggctctggcttagtggaggaatcagagcagccacaatatttctacgaagcttgttctaaatgcacatgatatcagtgttctaaaattctgaatgtggtacagctttcatgctagtgcagtatggaaatgcccctcaactctcccatgcctctcttcctcctgggtgccctgtgatactctggttctcctctatactaagcagcctggtccagtgtcttcccacaagagcaaaggatgagggacttgtgccccaaggtccgagtggaacacacatacacaccctcccacgcacacgtacacacacgcacaatttggttcacactgtatcctctgacagtagtcacctcttggccctgaggccatcgtcaatcaacagagaaaatggaacattcagtgaaaagtaaaaccagacccagccaccaataagatgccagagggcagtgggatgagtgtgatcattaaaaagtttatcattcagaaccttcatccttggaggaaagggtttcagtaacaacagctcaccaacacatgtaggttttaagaaataatatttatcgtctttttccaaaatgaaaggataacctgaaaagtaaaaaccttaggaaaatggtccccatacacgcactacccagaaacaacaccaatgttagacgtgtccctttattttcttctaggttttttttttttctgtaaactgatgaatttttactaacaattcatgcctgcacaacctgattattacaggatctagacaaagagcaagttcatgaaccatgtttttctgatgaaaacatgatcaaagcactagctcttagaaacagaagctacgattgtctcaggtgaacacaaaaggagccccgcagctgggaagatacgtgtgaccatcagcttgaaaactggacaggccacagggtcaggtagtggagtcctagccacgccaaaggtgcagacactgctgggagaggcacgaagcagagcctcctcagcccaggtgaggggtggtaaggcttccttcctggtcagccacccgctacaaacaccacccctcaaaggccggggctagggaggaacctgggaagtccaatcagcactgtcccataaaggattcccctctttcccacaactcaccatagctgcgacagcctgttcacagtttgctcagcatacattcaggacctgtcacactgtacggcccacatctgtctgcatttctgactccccttagactatgatatttgtaaagtatgagggccatgctccattcatcttcacgtcctttgtgtctagcagataggagaggctcaagatggctctcacccatccatgaacaccaaggaagtagccagcttcaggttctttttagattaaagagaaagggaaatgatccagcccagtcttgtcccaagctcagctctttagcctgaaagttaatgggaaaggcaggggtggcatgttagatctattgatcgcatgtgctacaacgttccaggggcccctgcttggtgagctatgttcaatttttgggaaagaggacaacgtcaacgctataattccgggtgcctacctcacaccactcaggaagaccataatccaatgacaactgagaatgaatagaagctgcctatctggtttcttggcatccaacacaattagggcccctccgccagggctctaggagcaccaagaacagtgatacgaatgtattccagggcccggcacatagtagatgttcaataaatacttctgaataaaaaaaatactgtatgccatacacagcacaggacaccaagagaggcctcagtctctgccaccaggaagcttttccatctaacacagtggttctctgtctagggtgtccatcacaattacctggagagcctttccccaatactcaggatccgggctctgccccaggcctcctgacgcaccctctgaagacagggtctagacatacgtactgtcaaacagctacccaagtgattctgaggtaaactcccacattgaagagcccctgctctagagagtaaacgaaagctattatttattatatttgtaaatattgggggagggggtgggagaataaggcagtaatgcttttttatttgtaagtaccaagacttccctccctgccctcccacgggttaaattttaaagtcctccaaaattcttgggaggaaacagaccaggtacaattgtcgtggtatccaaggggaccgtgtaatgtacccttgcagtcagataaagctcacggaaatcaagggcaactacctaatgatccaagggaccgagacgtgaccacgagcctttcctgattgttttctccaggtaaccaaggggcagctgctctcctttagccaggtgagaacactggatatcagtatctgggccccactccccacccaacgctgaaacctccctcagggatgctatgccaacagctgcctggctgggttctggagccgaaatgggcaacttgtacttagcctgcactcagacacctgcacacgtgtctctaggaaaagagggagtgccagcagcatggccagacactccctttcgggctgtaagtttttcctgaggctgcctgctaaacctcatgctaagacagacagacagacagactgacagacacacacgtccacagccttggagcccctttgctcaaggaggcttcccatagacaccttggcaaagacctacaaatgaagccaaggacacgtgtcctctgaaggggaggaaaaccaccaacccctgtgctcactcggccctcccatcccccttcctcaaatcggaagcctctgaggccagttaggaaacccagctttggcatgcatcatcagcccagaacccccacccgcccaatccatgctcccaccaaggtcaagagtagaaccgtcccacctcccctttctccccacactctttaaagcaatagattctgtaaattttccttttccctttcttggctcccctgcatatgtggctccttattcctgaggatacttagaaaagccatcctcctcccacctcctctgcagaccctccaaatatcagctttcgatattttgcccctctgtccattcccgtgtccttttgtaaatggcctcctacaggaaaagcacagtgaatacaaagatgagtaagacgtggtcccattcctcaaggagggcagagacacacacatagacagaaagttaggacaggaaacgccatgacagagagaagcctagggcatcacggagcacagagaggagcgcagatcacaggggctcctcaggagatgacacctcagttcgagtctaaaaacccgggatggactggtgctggcccagtggtgtctgcagacaaaggagaaataaagcaaagcacagcacagaagtaacctgtgcccaggtcggtgagaagacacttcagcaggagaagcaggtgaggtccaggtggggaaccccaggagggagcagctggaagccagcaggcagaagccagcgcctgcagggctaccccctctccagtccttggaggtgccacccatggttctgctgggctgttcccaggggtggtttcatgacttagaaccacaggcgtaagttcaacctgtcatcatggggcagccaagccaatggccctaattaaagtctcctgagacacaggcgtggctatctccttccagcgaggcccgtctctagataaatgctcctctaccacagtgccagaggctgcttctccaagtagcttcctactggcctttaatttggtagcacccaagcattctagtctgaacccaaccatttcaggttgcaaaatgtctctttaatcgttgggagtatgtagaccagagtttaggagcacacaagattagaagccacactctaaaattgagcccttcatttccccttaggttttaaataggcatatgaccacttggtcatattatacctaaaagcatacacactcacagcctctggtaacatagaattgcaggcaacagggctcttgtgtgtcaggagacccctctactctaaaatagcaaaatccgcaacgagagcacttgactagtagcttttgcttacatcaagtcatagttgcttcagcctccaggcctgtttccttctacacaaacactaccaccgtcaccaccaccatcctcatcatcaaatacagtgagcaactgctacacatctggcactgttcacagtaacactaggaagtagactattctatttcattgtttctaagaccaatcctagaatccattttacagttcattctttccccccgacatgttaacaactctgaaaggcatttcatattttagttggcaggattttttttttccttagtgctacataaactaaaggtacaactaaattgatagttcttggatttgaggaaataagcattttttttatccccatcttattcatatgaacactaagcttggagagggtaagtaacttgctgtaatataaatgtttgtaccagataatctggtcagtaaccagcacttaaactatttgaacatgtctataataagaagcagggctgccttccaatgttgaaacaaaaattagtcctgctgtgtccaagacatttctatctttggaattctttaaagatttgctcaattcgataatctgttcagtgactaattctatttttctcttcgattcattccgtgggcactgccttctctcctttttccatctccgcagacctgagttcgtaacatttcatccacagttcacccactcgctcagtctcacctttgggcccctggttactttgtcttcatcccaattcttcatactcttccaggaagactttggtgatttccacctggcttttctcctctcttctttctcctggcctctcacagggccctggcttggccaggctgatctcagacagcctagctataaaaaaaatctggcccccaaggccgggcacagtggctcatgcctgtaatcccagcactttgggaggccgaggcgggtggatcacctgaggttgggagttcgagaccatcctgaccaacatggagaaaccccgtctctactaaaaatacaaaattagccaggcgtggtggcgcatgcctgtaatccaagctactcaggaggctgaggcaggagaatcacttgaaccccggaggcggaggttgtggtgagctgagattgtgccattgcactccagcctgggcaatacgagtgaaactccttctcaaaaaaaaaaaaaaaaaaatctggcccccagagacagtctacagtgttgaagttccactctactgctgatgagtctcacgattttgggcaagttacttaacctagctgtggtctccattgtttcatccataaaatattagaccctatttcacaaagctgttgtgagaattcagagacaacacacatattaatacaatgtgctcattagcacccagcacacagtaaatgttcaatagtctcactgcatgataacattctgcttatctgtttacagtctccattaaactgatctccctggggtggggactggatcatatttcctagcacagccccaggacaagcactgtggctagctcacaagagcttaagaaactgttgaatcaatgaataaatggacacatgactgtgtgtataacacatgcaaggcactgtgctcaggaacacaagggcaaggcagccatgcaaactatcaactctaatacaaatgctaaatagatgttctggtaatgtgctgtacaagcacgatagagggaaaaattaactctgacaggaaagtgcactgaagaaaaatactgatggaaacacaggaacaaagacaaaggaacaaagatataagagaaaatggcacaagccacgacaaagaggcttagaatgcatggtctagcatgggcatccggctaagttcgccaccgggatccacagaccccttgaaactgaatggaaaactgagtgactatgtacctttctagggaggcagtccatagctgtctgttccttgaaggggtctgaggtccaaaaagatgaagggcccctgtgatagggtgttggtcatgggatagggagggtggagggagaatgaggaggggtcatcagcgcagagtgagcccagctggccgagggttagcataccagttggcagatagtgagctttatcatgtgaccattaatgggggtcctggggagttttcaaagagggaagaggggtgatcagatctgaactaaggaaagaaaatccatcagcagtagggagaggaggaggtcaatggaggagtttagggggagagttgaagaagccagcgggaataaggacagaaattaaaattcccatttaagaagcagggaaaggttcaaatgaacccaagacaaatctagtctcactagttatataaaaagaaaagaagaacagatctaagaagcaggctgggattcaggtggaggggagaggagatggccacgccctgggtttccccccatcttaggatttgatttgagatggtgagtttgaggagaaggcatgaccctcatggggaggcgctctccccagaggatgcagagctcaccaggggaccaggcctggggctgtgcatggattctggcaccctctcagggcaactgtgaaagcgcgacatgtttctgagagaaggccaagacagaaatggttaaaatggtaactttgatgttacatatattttaccacaaaaaaaaaataacaataggccgggcgtggtggctcatgcctgtaatcccagcacttcgggaggccgaggcgggtggatcacctgaggttgggagtttgagaccatcctgaccaacatggataaaccccatctctactaaaaatacaaaattagccgggcatggtggtgcatgcctgtaatcccagctactcaggaggctgaggcaggagaattgcttgaacccgggaagcaaaggttgtggtgagctgagatcacaccattgcactccagcctgggcaacagaagcgaaactccgtctcaaaaaataaaaaataaataaataacaacaactccgggaggaggtattattatcatttcagacatgtgaggaaactgggacttaaaaagcatctgcagttggcaaggtcacacagctactgcactccgagctaagattcaaagtctccaagcggccaggcacagtggctcacacctataatcccaacactttgggaggccagggtgggaggattgcttgagcccaggagttcaagaccagcctgggcaatatggcgagaccctttctctataaaaaaaaattagccagacatggtggtgtgggcctgtagtcccagctactagggcaggggtctgggggaccactgaggtgggaagatcacctgagttcagagggtcaaggctgcagtgagccatgatcgcgccactgcactccagcctgggggacgccaccctgtctcaaaacaaaaacaaaaaaagtctccaaggctttcacctccaccgctgggctctaaaaccaagatgccaacaggcccggccagcaactgaggaggacacagcgcaagcggccacacgtgtgggctgtaggaaggtggtgattcgctttttgttttctcacaggcacaatcagttccacgtgccctgtcttgttaggcatgttttgttcaggccctaaccctaccaatgtgtgttcatggagagtgatgctgtggacaggaggtgtcaccagatctgcttcatccaacagacagacaaagccaggtttccatacctcagctcacatctacggcaggaattcatcctgtcctagctccgtttgaaaacccgcctttctcgttcatgcccctaccaggtccacaggtgaactcctccctccctgtcatcatagctggctaaaaacttcccagtagcccctttgtgtcaggatggaaaacagacctacaaggtcaacttagcacctacccgtgacactcttcgacagcatgccagactcggctattaggaagggaaaattcatacctctgaacgggaccagaaaagaaagatgaaacggcatcagcagttagccacaatgaagacctcagtgtgtttggtcacccatcaaaaagctgacctatacccagaacccaaactccattcttagctatatcgacaggatctcaccccaaacaagcttttgcccagcaaattccacaaagcttgtcaaggtttgactccctttgttcccgtgaagtgcaaaccaccattaccaccttcttgtacacaggggccctttcccacacattagtttaccttcaatgatgtcctacatgtagcaggtccccaaagctattgaatgaatacaaacctcactgtttagacagatattctgattgtacctggcttttaaacttttttacaaagcaggttgattgccactgacttcattttgttccacttgaggtgctgagcaaaagatggatctctcagtaaacaccagccacaaaataagactcccctaccacctacacacaccaaaaatacaatcctcagaaaagcatgatcacatggtgcaattagagaagatttcagccccacggttttggattctattttctggataaataattactcattttctaattaaacaaacaattagtagaaagcacagcctgagaaactgtgtaggtgtccaccgtctcgctccgctgagatagtgtgacaaatgatgctaactcaggggtgaataaaacgtccttggctcctactgtttgcacaaactgatacaaccacacagcccagcatttacagtacagctcactccaaacatgaaatgaacacttttaatgattgacatcctaagtaagaaaacagttcctttagatgaaggccagatttcttggacttggggcaaacaagagagctggctagtgaatatattgaaggtagttttgtttattttggggtttgttttgtaggaccactgcagaaggttccagccaaaaatgagtcaaagacagtgacctacatatttctggctgctttctactaacattcagtgtctttgtctatatacattcagggacacaaagcaaagcaatgacctttatagatcatgtgctaaaatctgctggtttcatttggctaagcaaagttaatgtttactcttttgagtttagtactggtaaaagaaagtggatagctacagaacactagaggaatctccctacactagataaaggcagatggtacgcgcgtcttgctcctgctctactaatagcatccaaatatctctgcagtaggatgtgtctgcaagcacaggctattttaacattcattcatgtaaacttcttattcatttcattcactcaataaatatttactgagcgccaggtactgtggatacagagaacacaagacaaagtgctgccctcatggagcctacatgctagtgggagggtggaaacaggcaaaacaggtcatgaaaacaaataagaatttcatagaattctaagtgccataaaacactgccaaggaacagaaaggataaatggggtgtgcagtgggaggaggatggggtatttttgctgggcggtcagaaaaggccctcctgaggttatatttgagctgaaaccacacaaagatctgcagaagagcaaccaaacagagggaacagcaaatattgtgatcctgggatggaaaggaatttggccaatatggttgaacaaacaaaagggactagtggtggcaaaggagattacactcaggcgggcggcaccccacacagcctggcggcaccccacacagcctggcggcaccccacacagcctggcggcaccccacacagcctggcaggtatggttagggactcctgacgtcgtcgtacttgcaaaggagtctcgaaaatcaataaaaagctacaaatttaaatacaaatgtatgtatgagctcagcaaacatgatacacttaggattgatcatttcagcaacatgactaaaagcaaggaagtgagcttcagataaacaccatttgtacagcaccctagggcttaccaagagctttcataacatcatctcatttggatgtttagactggggcagtgaagtcagaggttaaggacaagcaataaaaagagctcctggctcttaattactaagaaaccaattcatcccgtctccaaagtggttaaagaggaaaagtccagagaccgcagattaaaagaggtggttttagcattctcctccctctgaggacatcaaataatttctctaaaatggcttaagatacagagcccaggagtgccaaaaggccaggtcaaccaaaagaaaacacagctaccgcattaaatataagaaatgggcatccttaattttccatagtgattagtcctgatgaagccatcaagatcatggctatgatcttctagaacatttttcttttttctttttctttttttcctgaaaagcctttgcatgccaatgccaataagctcattggggtagattgctccaaccactgcctttctaaactgacctcccttccacatccaccatgacaggctaggctccctcaaatacttttctccccataagatttctgacctccaaaattttcccactgagccctcctccagaatcaaatcctcacctgacctcatgacccgcaccaaccttctttctcccattgcttctacccccgttctccactccagagacctgtctcctcacagtcatgcatgggtaccaagctggacaccatacctcgaatgatggggcccctcttgctagactgtcctccctctttccacccacttgccaagtcctcaagggccaggaaagtcacgactttctcacgaagcccccttcactagtctcgccctcctggctgccttctactctaaaattgcatggcgtgcacagcaacccccaaagtttctctaaaggaaagataacttttctgaagatgaccaaagtggagacagagtgttccaggacattcctattcccactgggtggctcaaacattggagaaggattcatggcaacagcaaattagttcaagatgtcctgatacaagtttgcaaacagtggttactggacacctgacttcatcttgacaacagaacaacaccagacgcctcttatataagaggtgtcttcattaagaacacagcattctgccccaggaaacacataccatgatcaacatccatttcctttatcaaaataaggagaagagattgagagtctctgtccataaacacactatgatcaatactatttgtgcaggcaaggcaaaagctcaatttttgccatattcagtgaccatcaggaaatttcccaaccaatgcaactcacaaactcacataaagggtgcatgtttccatgcatagcaagtaatactctgtgaaagttttaagaaaaatccagcagctacatccacagagatatcagttggaatgcagcttcataatttctgaaggaatactaattaagaatgtaattttttcagcatttatgaagtaataagatacatccagactataaaacatacaaagacagtgttaacacattaatattatttttgttcacttaaaaatatggagaaggggccaggtgcagtggctcatgcctgtaatcccaacactttgggaggccaaggcgggtggatgacttgaggtcaggagttcaagaccagcctgcccaacattgtgaaaccccatctctaccaaaaatacaaaaattagctgggtgtggtggcatgtgcctacaatcccaggtacttgggaggctgaagcaggagaatcgcttgaacccgggagatggaggttgcagtgagccaagatcataccactgcactccagcctgggcaacagagcaagactctgcctcaaaaaaaaaaaagaaaaatgggaaggaaagggctgggcatggtggctcatgcatgtaatcccagcactctgagaggccaaggtgggaggattgcttgaacccaggaatttgagaccaccctggataacatgatgaaacctcatctctacaaaataatttaaaaaaaaatagctgggtgtggtggcatgcacccatagtcccagctacttgggaagctgaggtgggaggatctgttgagccaggaaaggcaaggctgcagtgagctgagattgtgccactgcatttcagcctgggaaacacagcaacaccccatcctaaaataaatacacacatgcacacacacacatgcatgcacacacacacatatgcacacacacacatgcatacacacacacatgcacacacacacatgcacacatatatatggagaaagaaaaagggcatgatgaagaagaaatgagacctctcatttattgtccaggaaagagagccaagccccaggaactgaatcttgcaagccatgaggatttccttcagggtaaccccaagcttgcaaatgaagtttctggatgttctcgctggactagtgcactatgttaggaaggtgagctgtgttttaaagtggccctgaaacacataatgacagcacaggagatatgaagaagggaaagccacataacattaaataagagaccacactcactttcacagcaaatgtccctctcagagaaaatcactccttagctgggaatggtagcaggcgcctgtaatcccagctactcgggaggctaaggcaggagaatcgcttgaacccgggaggtggaggttgcagtgagcctagatcgcaccactgtactccagcctgggtgacagagcaagactctgtctcacaaaaaaaaaaaaaaaaatcactctttaagagtactgcctgcacgtggagtaaaagctggtcacaagcacatgcatgacccagatgtggtgccaagggaaccgaacccacagccaccattccaaaaccctgcgtgaaagtccccaggggaggtggaagagtgagagttgctctcagccactccaccctgtgctattttaagcaccatgacttcattcttgtttgttctgaagcagcacagatgggccgcgtcaatttatgttactacaagaagagaaggagacccagattcaaagctgcacgtttctcttgccttgtgttagggcatcctgaagctggaactgtggtgtgtcgagcagaggaaagcactatttcttttttttcctttctcttttttagaagcctaagagtatttcaccaacgtgcccatatttcatggaaccaacagccagatctacctgaaaaatggcacaaggtgagttgctaataaagccatcgagcctttgcagctttgtcagtgccacccaactgtgaaatccatggcccttgctccagacacaggaagggtcctcttcctcagagagcaggagacagggtcaatgatccaagctgcagcatgatccagggtggaaggggctccaaaccacatctcacccggtcacctcggagggcacaaggctcttccctgaacctttccaagaaacttaatgaaccagactgtctaaggggcaggtacagaatatattattttatttttttattttttgagatggagcctcactcggtcgcccaggctggagtgcagtgccacaatctcggctcactgcaactaggttttgaattggtagaggtggtcattaccccacattatgaatgcactaaatgtcactgaattactcactttaaaatgattaattttctcttatgtcaattccacttcaattataaaaaacacttcaattataaaatatgcataatctgcatcagcgtcactatatatggtacaccccacgcatcgccaggagctgtcagccttgatgtacttggtccgcctcctggtgcaagcaattctcctgtctcagcctcccaagtacctgggattataggcacacatcaccatacctggttattcttatatttttagtaaagacagggttttgccatgttggctaggctggtctcaaactcctggccgcagggatccgcccccctcggcctcccaaagtgctggaattataggcagaagccaccacgcccggccagattacatttattaaacctctcccaggcactgcacaatctggttaaaaactcccaaaaatcctatgaggtaagtcctcttatcattcttttttttttgagtcagagtcttgctctgccacctgagttggagtgcagtggcactctcaacgcactgcaacctctgcttcccaggttcaatcaattctcctgcctcagcctcccagttagctgggattacaggcgcatgtcaccatgcctggttaatttttgtatttctagtagagacggggttttaccatgttggcctggctggtctcaaactctggacatcaggtgatccacccacctcagcctcccaaaatgctgggattacaggcatgagccaccatgtccggccctcttaacattcttgctctttctgttttcaaacagagaaagccagctccaagaagtcaggaaacaacaaggctgagctagcctccgcttcacagcaggtatgtggaggagctttgactgccctccgaggggcagaatagaagcttcttgaggaacactgatctttcactagtctacccaatgtgtcagcctcccctgccagcaaacaccatgtagaaataatgaataaagatgcatagaaaacaggaaaacccaagagccagtcctacaactgtcacttcccaatgacttggccttgagcaagttccattgcccttgagctctgttcgggtcccctatgtgtaaaggtgtgtttggttctccctctgacacagggttggggaccaagtacatccaggctgacaggtcctggtgatgaatagggtgtaccatatatagtgacattgatgcagattatgcatgtgtgtgttttatattttgaagtgaaattgacataagacaaaatcactttgaagtgaacgattcagaagcgttcagtgcattcacaatgtgagtaatgaccacctctacctagttcaaaaacattttcagtgccccaaaataaacccccatggccactaagcagtcattccccattccctactctcaccaacctctggcaacctggaaactgcttcctatctctatggatttacctatcctgagcattccccataagtggaattatatgatatgagacctcttgtctcttgactttcactaacacgtttgaggttcatccaagttgtagcatctgcacttcgtccctttttacggttgaataatattccattatgtacataccgcaatttgtttatccattcatccagtaatgggcagctgagatgtttccgccttttggttatcacgaataatgttgcggtagacattcatgtagcaggtgacgtcttttaaggcactttcacatttcattctaacaagtatgtgaggtagaccctggtcatatgaatggcatttgagctgtgcttccttcctcattaagccatcactttctaatcccaccccacttttataataagaaaaacaatgaagaacttctaaggctaagtcgggcacatgaagcgtttgtgaaggaataaaaaggtattgattaataatttgatttttaaaaattaatcataactcagaatgtgtaacaggactgtctcaaaactggacattattcctaacatgcatggaaaatgcaaagatggtattaaagattaaattctttaaaaagtaaagacactgcagggacatggaaagaaaaatgatacaggaaagaccaaagcaaagctcttcatctccaaatctttgccatctaatttagtgaccagaacactcagacctttctttgaacagagccatttttatcaagtcaagatctcacgaccatccaaagactctgagctcaaaacctcatgtggacagacgcaaatgtgaggcaacctggccagccttctgctgctctgctacaggtctgggcaaatgaaagaacgtgctcaaatctaaactcaggtaatggagaggctaatgttgtcaacatcaatattgtcactgcttccaagacaacttctcagcaaaacaaagagtctcaactccctctaggtgttaagaatcttcaagtatcaagtgaaaaggtctccgttcccttgaattcttttttaatccaaggtttggggcttcaaattcagtataaagcgagtgcaatcacagtaggttacttgaaggggcaaaatgcaatctcaccttaggagccaggcctgccagacccagtcccatcaatcagccagccacgggcacaaaacacacgctgatgaaaaggacttggcactgtgcattgtgtcatgtccaatactcgtcattgtatacataataaagtcagtcagatgaacattctcatactgtgttccccatgtgatgcaaaaaataacaaaattggactattgagaattttaaaggcacacagaaaaaaaagggagtgctaagcctacaaattctctggctggaatgataccaaagtcctccttctcatggtctccacgatcaccaattgttcatttctctcttttgtcttccccaatcaagaccctcagttcaggggtacacaaatcaggaggaggcagggagaaaattttttttaagattaatcttgaacacttaaattttaccaaaggcaaggaaaaggtaagaggaaatatattttctacctctacctccacacccctagcccttccctcccaagggtactttgctttaaagtgaaatcagggacattctgccaggaaaggtcatttagtaaacatgtcaggctttgagggccctttggtctctgctgtgactactcacctatgccactgtagcataaaagtaaccacagacaaaacccaaatgaatgggctgtgttcccataaaactttagggatgcactcttacatttgaaattcataccatttttgcatgtcacaaaacattactgttttcatttttttccccaactctttaatagtcattcttagctcatgggccaatagcaggctgcatttggcccagaggctgtagtctgcctaccccttctttaaatcatggatgctaactttttaggatatggtgtatctggtttttttctttatttataggggagggaggtttaaagttctgcataaaccggaaaagaacaaggcaaggacattacaacagcatatttcagaaagaaaatacctacccctgttctgtgaatctcaagaaaatttaaagagtcctttagtcacctgttggcagaggaccacaaattttaaaatatgcttgcttactgctaaaagttaaatgtttcattcctttctctttgataaaagaaattcaagcatagttactcctattttctgaatcaaatcagtaagtactcactagatgcctctaacgtgtctagtactggtcatgctgccagaaagaaaggacatcaaaatatatcttttcccccaaacattttgatccccgagagattttagtgttatagcttcagtatgaaggtgacaaattgagactgatccctcccaaaccatgatctcagctgatcccctttcatccactgaatgcattttagagatgagtttggccagtggatagtatacatatttatggcaaggaagctggcatagtatcacaggaataattccagacttaagatcctggttctgctctttagctctgagacctggggaacactaatcagcctctccaaattctctatccagttaagaggagacctaaaaacatccttctcaaatagccccaccacttgagtgcagggtctgtgtattagtccattttcatactgctatgaagaaatacccgagactgggtaatttataaagaaaaagagatttaatggactcacagttccacatggctggggaggccttgcaatcatggcagaaggcaaaggaagagcaaaggtacgtcttacatggcggcaggcaaaagagcgtgtacagaggaactgccctttatcaaaccatcagatcttgtgagacttattcactatcacaagaacagcacaggaaaacccacccttgtgattcagttacctcccaccaggtccctcccacaactcgtaaggattataggagctacagttcaagatgagatttgggtggggacacagccaagccctatcagcctggtaggccctaattcatcctctcattcaacaaaggttttactactacagtgtactgggctgcaagagcacaaagatgaacaaggtagacccagtctctaccatcacggaacctgcagaccaattcgttagctattttcagcagaaacacacaggcatgcctaacatgctccttcgactataaaacacctatcccttctttactttccccactaccagttccactttaacctgtaagtctgggagtagctctggagcatgaattcaggagatccttggcattcgaaggcttaaactctcatggttggcgctattcagaagttctctggtccacagcaagtgctaatttacggtttggccaagacaagatccgaatcctagaggaggcaaggttgttttgtgagggcaagtcctttagctaagaagtaagccaagcctagtgctggcatctcaacttgggtttgttctcttcatttaaccaaaggttttatttaatccttgcaactgctctaataggtaggtatgaccatcctcactgcagtcgcacactgtagtggctgcttagcatttgaaaattcacaagggtcttgtgttatcaccctccaatgctcgtggtctaggcagtggtatctaattctggctatacttagactcaacttggaagctttagaacatactgatgcccaagtcccatctcggatcagtaaaacagtctacctgagagtgaggctcaaatattaggacttttagaaagttatacatattaaggtgcatgcacggtcttccattctggacagttggccccactgggccaaaatccttgcctgatctgcttctagagcccttctaagaagccagcccagtcctctgtggaacatgttcagagcatgttggctagaccaaggaacaaactgccatatggtcaaatgtggatgtgatatggaaactcctgtcacctgactcataaccttccctatccatgcccaaaatgaacttcagaaaatgccaacacaagacttatagtatatgggaatctcaaaatttcgcatgcatttgcaacaaggtctaggagaaacagcatagaaagctgcctaactcttcaacaggagaaaattcatacgatgcattgtataggctttaatgaggacacccaacagttaccctcaaatggaattattctcatgtacccactattttgggatttaattaaaatttcctttaacaactgccaagacattctttaaacttagtctttattaccttctccagaatttttttttttaatactagggtgagcaaaatgttaaatcaggttctcttgatcattatgtatgtattaaacccttggaaacacacagggaaagctaagactcctatcagtttcagtgttcaatacatgaagcatgaaaggcagaatggttcttcaagatgagatgtttaaatggcaacttctttgtcactggatcagaccacacatgtggaacacaagggctgtgtccaagcaggacaactcaatcgcaggctcaggaattagatattgagaaaaagtactaggcgagatcaagagtcaaacagcctgggtagggaagggcaggagtcatccgaacggggtcctcatcccctccagatgtcaaagctccaggggccactgccagccagagctgctgcctctgctctcagctaacagtggctaagaaggaaggcctaggcagctgagtcccaggggagagcacacttggaggggcattaccccaaggaaaaggtggaaaggattataggaaaaaacaaaggttgtctatgtgccacaaggaggggcttcaggttcccgtctctaacataacatttctacagcactaatagcatatcatgtacctgctataccaatagtatagtattaaatacttccatgatagttatgtcttgcaaacagcacccaggtggtcttgactaccaatggactctaaatagagaaacttaacaacctattacatgtgtcagagaacattcactgttgccaagtagtgtttctataggtacgaatgaaggacactcctcttaggcaaaacaggtaaggctttgaggagctgtcacatctacccagctgctttgaggtcattgcttctctgcattttatgttaccccagtctctactcctaggggaggatggttcggcaaggtcaccaagaccctcctggccagagtggggatttctttagaccgcaggagaggagctccttaaccacctttaagcaagttaataatctgttcagggccacctgaggattaagtggtatagcccagagtagagagggtcccccagcatgaaagagactccaatgtcctagtgtcagatgcaaaaaggaaaattacagagctcagcttcctcctaagtgaaaagctgaacttttaaaaccttagacaaatgtgtctatggagtcaaaaacaacacagagaagctgtgacatttaaaaaaaaaaaaaaaaagcaaatgatgaactcaagtaacaaatcttccactcagcatcccagcggcagagagaaatgccaacctcaggactcctacatgtgttttatgctgaaggagctatttcaagcagcaaaggttctgcttctatgccattcccagtttctgttttgttttgttttgaggtatgtctttttaaatatccacgataaaaatgtaaccatcccaaatatatttcaatgatagaaatacatgaccactgtttagtttaaatcaacagtatctctctcaaaactgcctcctggctgggcgcagtggctcatgcctgtaatcccagcactttgggaggccaaggcgggtgcataacttgaggtcaggagttcaagaccagcctggccaacatggtgaaaccccatctctaccaaaaatacaaaaattagccgggtgtggtggcaggtgcctgtaatctcagctactcaggaggctgaggcaggagaattgcttgaacctgggaggcagaggttgcagtgagccgagatcatgccattgcactccagcctcagtgacaagagcaaaaaaaatgccgtctcaacaaaataaaacaaaacaaaactgctttctataaagattactataattgataggaagcccagagcatagtgcctgacacatttgtatgtgctaataaatactagctttcctgattcatataagctaacgattgaaggctactatgaaccaggcactgaaagctctttatacaccttctcaaagactccacacacagcctacaaaggtgctgttatcacatccaatttacagatgagaaaacaggtacacagaggttaaggcaacttcccaaaagtcacactgcaaaaaagagtgcaggctgggattcaactcaaatcaaaggttcttaaacagcagccatgcactttcttaactctaacaacagggtagccctcacgccagaataatttaccatcttttccattttacgctaaagccattttgggggttgtctttaagtgaagtcagagcaggggtggggacactagtcatcaacttgtgcccacccccatcttcggcagcctcccccaggctgtgctcggccctatttgctaaatagcaggtccctggaggttgcacaaccatcagcagcaaagtagctggaatccaaaactaacacggctatcccttcaacgcttcctcttcacctcgggcaaataatccatcagtgcacaaggccacaggtgtgaggggcggcacagagacaggagagaggccccattccaggagagtaagcctttggatctgagcctcacggaacaggcaggctctagcctacagcctccattcctgcagggtaagaatacagtagacaggaggctaaagtggccggtttggctctcgtgatgcagaaggaagcctggagtcagcaaggggagaccaggctgctgaatgggccagtggctaactgcaaggccagctcagggcagctaactgaaacagcagctcctacttcaacgaaggggaactgggtggggagggaaatgacccagtgtagacattgtccttacagcacacacaaaaagcacatgcctacatatgacaatgatggaatatggcatttcaagccaaatttatactaaacatcaaagaaaaccagggcttttctgaaaccaaaacacatttctaaccactttcttgaagaaaacaaaaatggctgggatctgaaccaggcataaccattttgtcttgctttttgaaagctgacaaatggtcatcccagcccttccttccccagtctatgaccttttcagaccatcttggttcctctcctgatgtttcctaaagtagtgaaatgacagtacattcaactatctggccccattttatttccatgtgatttaaacctgatgtttaatgtgacagcacttccatttaaagtaagcaaaaaaaaaagaaaaaaagtttcttatacacaaatgttttaacgtttaatgtgtaatgtttaacatgtggttaaaaaggaagcagcccacaattttaaaaaaatgaaatttaaaaaatggaagaaaaacaatgaccccaaaatcctcattcaaggaattgtgaacagaaacaaagtcttacaatagcctgcagtacactatcaaatactagctttatgtatatatagatatatacgtatatacacatatagatatgtacacatatatacagatatatgtacatgcaaggatccaaacctagtagggaatttccaagagtgccagcttctctgacaccctggaaaggaactcagaaacacaggtgtctctccagactagaaaacctcaactggaggccagaggtgggacacgccctaggaagcatccagacagacggagtggaacaacacaacctttccaacacgaaggagcccactgccatatctgaatctggctgcaaatctgtcaagacacagggcgggtggaaacatcagaaaccatcttactgacatggtcaaccaatggctgagcagacacactcaggaccaagaccccataatacagcagttaaaagcctccaggctctggaatcagagcccagttgcagcctcttccagtgtcaataagagaagttaccaagtggatggtggtgaggccataacaagccggtacccacatgcggtgggggctctgacaccactcccatttccattatcaaaccaaggagaccgaaaaagtgacctgggccataggattctcaaatactgatcatctgaacaaatagaatcttgtatctgacaacagcagagcagcacaaccatttggtttgcagccacggccaaaacttggagattgcaaatgtacaatcagagtaaagacagccacaggatagcaaaaacctttctttatttctttttttctagacgaatgaactgtaagctactttgcattccttttaagcttcttattttttagtgtctgataccacggccattaaaaacaatctctaaaaagtctttgttgcacatcagaatgagacagctgggttactggcatgaggaaatgttcaatcttgtcattttgcaaaggaattcatattcataattaatgacgcttttgtccatgccagaaggaaaatctaaaggctcaactatgcctaagtaaattctaaccaagccaactgcaacacggttttataaattatagagcaacagaaaagaacaagattttgtgagttgcaagcataaagaaaagaacgaatgacaaggcggccatgtttcaaggaagcaatgagattaggaacattcatttctaaaaggatgggtagattttccttctccctcataaaagcagcagtaattgaaaacttcaacatcataagaaaaggcatatatttgacctgctacatgtatttgagagatttaataacactttctttgtgagtgtgccagacagataccaccgggttccatcactggccccaaatgtcaactaaagataatgaagtgggggcagataagctacaaagttaggtttggtttaagaggtatgtctatggagatgctggtagataagtagaaaaccccttgaaaaaacactagtgaaacatttcaaagaaatgttcttaaagataactttgcttgtcacatagccattagatagataaacaaatgtgtgttcaagtagaaactcattccattcattcaaagaagatgtatttggcccctactatgttaggggctaaggctataatgataaaacacaaaacactgccagaagctgggaagggtggggacagggagtaactgcttaatgagtatgagatttttgtgtgtttttctcatggtaaataaataaataaatataaaccaagaaattcactattttaattaaccatttctaaatatacaatcctgtgacattaagtatattcacattgttaatgtaaccatcaccacctccatctccagaacttttcatcatcccggtacggggctttctttcacggtaatgaaaatgttttggaattagatgaggtggtgtcacacagcactgcaaaaatgtccaaactgtcactaaactgtttacttaaaaatgattagttttatgttatatgaatttcacctcaatgagaaaaaaataaaagaaaggagcctggatgcagtgacccatgcctgtaatcccagcactttgggaggccaaggtgggagaatctccagaccagggaacaggtaatgtacagtacagtgctacgacagcgaagcccagattctgggcagagctctcagcggggatcctaagcccctcaaggaggaaaggcgtcctggaggagagaccgcctgagataaccttggaaggtaagtcagagtctgcaggtgagggaagggagagggcattccgagtgtgtgtgatgcaggagagaatgacatattcaacacacctggggcatgtactggggagacagccaaaaaccccacattcattcaagacaccattcatcccccaaatctaatcacaaaacatacaataatggggtgaacattataattatacatcatacttaaaatatttgtttaaaataataattataaaaaatacttttaaaatgccagaagaagacattcaggagaaaacaaggactgaactggatcccaaacagcggcagaagttggagacagacaagtgggaggggacaggccacgcggggtgaaggcggaacgcaagtgagcaccatgtctctaagtgaccaaggagccagcagtcggaaggtggccagggacccccaaagtcccaagtcacaggagcaccacgacctctcatcacagctgcctgggtttacaatttataaaatgctttcacaactatgacctcatttgacttccaccgtcaccctgacaggcaggtacggcagacctgactgtcatctcatagacaacgaaactcaggtgtgtccagctgtactgacccacccagggccacacagctgtgagcaggcagagggggcctgcagccgcctccccatccagctccgcctccctgagccctctctccatcacgcagggagcgcaacacgaacgggaactcaagcgctctgttcaccccattcctattctcatttgacttaatcttctgaaaacaaaaaaaaaaacttgcatattttcactctgggaaatgaccttttggtaaaaaggaagcagtctttttttagtaagatgtggactctttacagagttgtatacgtgcaacttggcagagtagttgtttttcagatgaaacaatgcatggactgtcgaattcctaacatcataacttagttatgaatgatttcaaacctagcttcaatgaaccaagctagctacaactgcctcaaaaaaggcatagccagagttccgttaaattgcccaacaaaacccaaagaggtctagcttggtgattctcaaccagggctgatctcaatacacatttttggttttcacaactgagagggtgtagaggccgagaacgctgctaaccaacctacaatgcacaacacgcccctcacaactaatatttatccagccccaaatcacagattgagaagccctggtctcaattctgaggtgtttccataaactgatccctgaggtgggaagaacctggtactggagtgtcacatagacgagatacacactccagaaacttatgtctggcacacttggttaaaatggcaggcagcttcaaagttgtgtgccattttaaccaggtgacttcaagtcaccaagagtttccccatttgcaaaatggggttcccactacctttctcaacctgagataaggcagctggtgggcaagtcgagaaccccaacagcagaggacccacagtcaatgctcaagaccgaggctggactgagctcactaaatagcacactctcccggcactcgctttatccaaaacatttgaaaacacaaacgccagagcgatgggcatcatctaaataagggtggagacaattactatccttcaatctcattaagcaggagtccatatgcctgcatggaaaccagggcttgggatcactgtcatctcccacacagacatactgtagtcagtgaccggtaggaccacctggaccactgcaggaggttgggtggtgcgtttacatggctcatatttcctgcagttccagcacaagcaacacctcttgcacttgggcttaaatcgtattatccaaatgaagtatcactctcctaatcagcatcccctttaagcaagcacagatggcaatcacgtgcttaagtggcaaatcaagggctgaaatccgggcaagctctcccaggctctcggatctggttctgtgagtgggttctgagagagacaggggtcaggaaacacaggatgactggcacacgcagagagctcaaggtcttttgtctgccctcaagcccttctggtgaaccaaatggactccaccagagtcagcgggtaaacacccttgtcagccttgcaggccagtcattctcaaagagaagcctgtggatcagcagcacaggaagaagaatgtttactatcgcctccacaattcttttgtattttatcagatcctctggccatctttgagaaactgtgcactgtcctacttctgacaatcagattaaaagggcgcgtattaaaggtccctttctgtcttagcagaaacagtattttttcattttacttgtaatcaatcagctttgccccctttcctgattttaaaggcaggaagaagcagcattgtattgaactgtgaaatgcgctcaaatgcggctctaaagggaagtaccacccgggcggctggatattagtttccatggtaaccgaggtccctgggccctagcacacacagcaggaaatgctgcagattaccacagcagtgtcttttactagaaataagagttccatttcaattgtaaacatttgggaatcaaaaaacgtgtatttgtgtgtatgtgcgtacgtgtgcgtgtgtatgtatgtgcatatgtgtatgttgtgtgtatatatgcgtgtgtatgtgtatgttgtgtatgttgtgcgtgtgtgtgtgcatgtgtatgtgtgtgtatatatgtgtgtacgtgtatgttgtgaatgtatgtgtatgtgtacatgtgtacgtctgtgtgtatgtgtgttgtgtgtgtgttgtacgtgtgtacatgtgtatgttgtgtgtatgtgtatatgtgtatgtgtgtgtacgtatgtgtgcatgtagatgaattgaaggcaatgtaaatgaattgaagcctcattattcttacagttaagaagcttatgtcaaatgaaacaaatgattaaaatgtaagcaaaaatagcctccccccttccaaagagctaaaagaaaacaaaaatatcttctgcagaaaaaggaagaaccagaatggaagcagagagctgctttggaaaccagatgaccacgggtttcttattaacaaacaagcaaaccaaaatgtctgtaaacaatcaccggctgagagacagaacagagatttttttcacaacctatgctgtgtcctccttgaactccctcaccatgaaaccaagaagtcagagccaacaactgcttaggtggtttttaagggaaatcacgcaatagaaaacccaacgctagaatccccagtctccttcctagctgtgtgacctcggacaagtgacttcactgagattcagtgtctccagtaaaaatgaaaatgttgcactagatactaggtgagcagaagaaaaaaaaaaatcctgtatcttctcaaaaatgaaagaccagatagttcctttaaaaaaaaaaacttccaagtagttctcactttaagctttcttgaagtagtgtatacaaatctaatgtctttaaaatgagtcagaagaattcactgccaaattctcggtgacagaagacctttttagtattctataactattccttgagttattttctggtaacagcacttttcctacagcagaggacacaagcgcaggttaaagtgaaaattttagttccaactagctttcacattttgtgcgtgttttctagctgagactttttcaaagggagcacagaggaggcatctatgtggtctgaccaaacagacccgtcctagaaaaatactagtttgacaacttcaagtatcttcaagttcacatttacattccagatggttatttttatctaagatgggcagagcagaccaaaccaagttcatagctctatggcaaatgattcttcacaagagaacattaaaaaaaaaaaaattcttggctgggcgtggtggctcacacctgtaatcccagcactttgggaggctgaggcaggcggatcacctgaggtcgggagtttgagaccagcctgaccaacatggagaaaccccatctctactaaaaatacaaaaattagctgggcatggtggcgcatgcctgtaatcctaactactcgggaggatgaggcaggacagtcgcttgaacccgggaggtggaggttccagtgagccaagatcgcaccattgcactccagcctgggcaacgagagtgaaactccatctcaaaaaaaaaaaaaaaaaaaaattcttcgcttcatctgcatgaactaaaataactgcattctttcatgaatgttaatattttaccaaaagtgactacaaggtatgtgtgtgtggcagtggggatggggtggggtattagttattaagccaaaacaaaaagccaatctatgggaagcaaaggcaagaactaggatggaaagaggtgggggaggagaagaggggagaattgtcagtgcttgtatacaaaatgcacggtggctctgttagctagaagtgggcaactgctgagtaaaccactttattatgtaaactgcctaacaacacaaataaccacgctgcacacaaatcaactcagtcacccataaaaacacacatcctctccaagcttggaccttcctccccactgctgctgctcccgccgccgccaccaccatcgcataattcaccggcattgatgaaggctgccgaggttagacagggaacagcacacacacatccagatgtaattcaagtatcatctggggaaatacactaaagcctaatggggaaaccccattgaatggagcaagactttctctctgttaggggtaagacaatcctgagcaggacagacacacatgcttgggtgtggaattctgatatccctcactgtccctgctggaggattatagaattctggtgacatcctgccctgaggatccaggatatgttttggtaaatgtgggattccggtgagttcattctgggctaacacatgatgactgccctttcaagtgtcattccaggaagacatggttaaaagcaaaacacgactgaggcaggagcactggttgaccacaatgaacaattctctctggcaactgctgctacccaaccaaagatcaataataaaaggccacttgtcaaatggggaacagtgctgtcgccaggcatcagtttttacatcaagaaaagagcaatgggattagaaaggagggattcgttttatcagcagtaatgctaggctcatggttacaaatctcctaaatatacgtacttgcccgtcaaaataatcaaacacataagcaaccataactccatcaactgaaaaacatcaaaaacaaggtatttttttaaatttataaaataaaaacactctttaaaaatatacagattcatttgttatttctagttcttatgtatagtatgagttgtaaaaatgctaaaaatgcatgacaccctactgtcctgggctcaacacaaagtctgaagtttcatagaaagcacaccccaaacaatgacagctttaaaaaaaatggggaatcgtaagacaaacttcacatgcccgggccatttttaaaaagatgttttattcatagcagacgtatatgactaaatacattgtgctaacaaattaaaatgacgcaagacaaattgaagtggaaaaacaccaaaatgatgagaccaaaagcagactgtacatttacaaacccatttaaaacaatattttttttacatcacctcccactagggcaatggcagctctaaaatctgtgtataggagggcttaggagctggaaaatttatcttgaagatatgcttacataataaccacagtttttagctatgttgcctattattataaatagcaatcatttttatagattttatttgtactttatgtaagattgagattataaaaagtgctcaatataaaaagtatatggatacacatacgtacatacatgtacacaaacacatacacatatatacagtttagatggtttcaagagttgtttatttttttttgagaccaagtcttgctctgttgcccaggctggagtacaatggtacgatcttggttcactgcaacctccgcctcccaggttcaagtgattctcctgtctcagcctcccaagtagctgggactacagatgcccgccaccacacccagctaatttttgtatttttagtagagatggggtttcaccatattggccaggctggtctcgaactgctgacctcaagtgatccaccggcccctgcctcccaaagcactgggattacaggcgtgagccaccgcatccggctgatatacctttttatttttaatcaaatgaagaaatttgactacattcctttatggtaatattcaaagaattttcagttccagacctaaaagaagggccttttatatgatgtttttaatttgaaaaaaaattgttttcagtttgaggctaaagagtttggtaagtagtaataagaagacaaatatttcaggtgatagatatcccaattaccctgattttttttttttttttttgagacagagtctcactccattacccaggctggagtgcagtggcatgatcttggctcattgcaacctccgcctcctgagttcaagtgattgtcatgcctcagcctcccgagtagctggaattagaggcccgccaccaagctcagctaatttttttgtatttttagtagagccaggatctcgccatgttgaccaggctggtctctaactcctgacatcaagtgatccacccacctcggcctctcaaatgattcgaactttacacattatatcaatttatcaaagtatcatatgtgcccccataacatgtggatgcatcaatctttttaaaaagaaaaaaaaaaagtttgctaggtagaaatagtaagactctaattacacgaaagagttctgggcttgaacaccaaaggcaatccagaagttaaaggctagtgaagtctcaattaaacaatctggttaaaataaaactcaggagcaaacaagagcagtctggctggagccaggaaacaacccagctgggaacccaaacaacccagcaccttctcccctcagaggaaagattccctcccctcctccactccatccatgaagcagggtgagtgccttctacccagttgtcctttgcaccagagacttgacctcagggaggggtcaccaagattcaaattctgaactccagggaggaatcctgccaagaccccatcccaacagccccttgctcgagaactgacgggcttcccaccaggatccatgagggctgcataaaagtggaagctactgtttgcacgcagtcgttcattcagcagatgggtctgcaccctgctgaaggccagatactcagcatctgggaaagtgagttcctcaggaaggagcaggtcctgttagaggtgtctccaatctggtggggaagatagtgacagcacagctaggggaatcctctgaccccagcatgtcccccgaggccctgagcaaggacccagtttacttcctgagggaagacaaaggtctcacaagtgatacagctcttaaactcctgggagacaagcagcagatcctcaagcatacaaacagggtgaagaaggggagggctggaaaggacattctgggcctggaatgcacatgtgccagcagatagggatcaagggttttaagggtttcagaaaacagtgagcagttctttgtgggtgcagttgccggccatgggtggggagatgtcatcggacaggtgggttatggcaagatggcaagaggctttacaggacagcacaaacatacctcaatggagagcaacatctcctggaaagcttttcaaaattggagattcctgggtctcacccagttattctgattccatgggagtggcagggccttgaaatctgtcccttaaagtgaacttcttgagtgactgtgatgcctaatgccagatctggagaccatggcatttaccaaaatctgtactgcaaatgtgtaacacatttgtaagaactaagccatcagcaattttcttcaccaacatgcttcaccaacctcggcgatccagactcactgattaaagcgcatgtctgatggaccagccttcgatgcctgtcctagaaggtccggcgtccacctgccttcctcctacacacactccaagtctgagaggggacctcaacccaaatgcccatctgtaattttcccttttctcttctaaccttctctctccattatctttggcttaatcttgcttcctccacttcctttgtactcagagcaaaaattggaagctctaaagataatatagaaaaggaaatttacacttcattcatagctaataagaaccaaggcaagattttaaatcatagaatattagagccaaaaaaaaattacttgtgatgatctaggctcctaggccctttataggtgggaaaatggaagcccagagaagggaaatatttactcaaggtcacatagctgcaaaggcacgaagtcaaacctacgtatcccagatcccaagctagttgttattctaactaccgcatatagacttttgttatttcaacaacatagattattttttgtgctacacagattttttttaatgcattcagaatcaaaatgggatcaaaatggggaataaaattcgtacgcctgtaagcctgtgcccttacacatcagggacttgcgcggagtacagagcggacgacacactccctcttagtcagcactggcccatcccggccactgtgccatctgcttgtgtcagcaagggcctttgaagagcagtgttgtgtgactctcattttcatctgcctctgtaattactttcatggttttgaacaaccatctcagggaagtttagatggtaatacatccaatgcctgaggaaggcatttcagattctcagaaggaaggaaatggatcccaggcagactagatcatctttaatgtccagaatcttaaatttgttaccctaaaaagtaggcatgattttaagactgaaaatcaggatagctaggctttattgaatgtgtaccatgggctgggctctgttctgagtggttcatgtgtattaagtctttttgttctcaccacagcctatgtggtaggtacttaccatctttttcttaatttccttaattttccttttcttatttttttaagtagcccagacaaatgcatgccactcagttcaaatatttctcagctcctgtaatagccacgtgctggtccattatggatgtgaaggaagcagagaccctgctccacaaagcctcgggttccaagtctaccagatacctagaaaccaattctttgtgttcaataatacagaaaatcgtactttcatatttaaaacaaattgtatattcatccagagtctaaaatcaacaaaatatggaactgcgcctagtgctaataaactgaaattccattatagtttaattattaacccaaatatacacattataatatccacttatacactttcatttaaaaaaaatgaaagcaattaagttctaacatatttccacattctgtttaacaataggtacataacaactagattgattttgctcttatagtgactagtattcaaagtttttcctaagtaaattttattaatagctagtgcaaaagatttcctataaaggacaaagaccactcagagctgttcccttttggaaacaatatgagatgctaatattttggaaaccagagcgacctgctagcttgaaatgctgggcacttgcccagaagagatgcacttaatgataactgcaattccctcctaccacttccatcaagagggataaaaaaaaaaaaatacatgtaaaggctgtaagcaagggagtaaccaaggatattctttctggagaaggtagatatcaaaccacaaactctgttagagtcacggcctacaccaaccctaagcccaaatctatttgctgctgaccaaaacagcttgaagcactttttacagattatcatttccttggtgatccatacatcattaaaaatagatcacttgtaggactccaaaaggatatatacatgggcattaattgcagcagagcttgtagtagcaaatacctggagataacctaaatatctatcaagagaataatgactcagttgtgctatattcagacagtgctacattcagaaattccatttggccgctagaaagaataaggtggacttataggtactggaaagataactataatatactatgcagtaaaaagcacagaacaatgtttcttaggggctaccttctgaaaaaggtcacacaggtatattttattccatgtgtcattccacatattgtggaaaactagtgttgttttttttttttcctcccagcatgtttgtttatatatgcaaaaacatctgtaaatgacactaaacccaattcccgggaggggcggggaagtggggaggataaattttagtttatatatttatttcaattttttttttggacacagagtcttgctctgtcacccaggctggagtgcagtggcgcaatctcagctcactgcaacctccacctcccgagttcaagcgattctcctgcctcagcctcccaagtagctgggattacaggtgcccactcctctgcctggctaatttttatacttttagtagagacaggatttcaacatgttggtcagggtagtcttgaacttctgatctcaggtaatccacctgcctcggcctcccaaatgctgggattacaggtgtgagccactgcgcccagcctacttatttcaattttttaaactaaagagcatgtcctattttttaaatttttaagtaaaaattaataaaagtcacttctgacacttactaagaaggacattcgagtttctcttatctctgtaaaatataccttctttctatcacccatatacttttaggttatttgagagttctcacactcccacattcaatgaaaatagtagcacgtatggattttaaacagaaagtatcctggcatcactaaaaatgatctgaaatcccatggtctaaaaatatgtcaaagcagccagatgcggtggctcccgcctgtaatcccagtactttggaaggccgaggcaggtagatcatgaggtcaggagttcgagaccagtctggccaacatgacgaaaccctgtctctactaaaaatacaaaaattagctgggcgtgatggtgggcgcctgtaatcccagctacttgggaggctgaggcaggagaatcacttgaaccctagaggggaaggttgcagtgagctgagattgtgccactgcattccagcctgggtgacaagagcaagagtccgtctcaaaaaaaaaaaaagaaaaaaaaatgtcaaagcaggagtttgttcactatgagattatttgcctttggtgaaatacatcacctccaaactcctactctacccccatcacttctgcagtgaggctctttggtttctttttgcacaaataatggctgtttttcttcccttcaaagatgacaatttccaggccctgcagtgtcccgccaagaaccattctgggagcagcatcttcagaatcccaggttcccactacaggaacttatggacaatctgggaatctctttccagtccatctacaggatccatccaagaattaaacattaaaatataaaaacattattatcacagagcctcaaacatgcaatgccagatatctaagttccttaaaacagtagagcagcttaaaaaaaaaaaaagacatattctgggccaggcacggtggctcacgcctgtaatcccagcactatgggaggctgaggcgggcagatcacctgaggtaaggagttggagactagcctggctaacatggtgaaaccccatctctactaaaaatacaaaaattagtcgggcgtggtggcacatgcctgtaatcccagctacacgggaggctgaggcaggagaattgcttgaatgtggggaggcagaggttgcagtgagccaagattgcgccattgcactccagtctgagagacagagcgagattctgtctcaaaaaaaaacaaaaaacaaacaaacaaaaaaaaaaccctatactgatggctattacagaaagataaaaatatggctgccaagtccagttccagatactgctgaagtagaagaaaatataaaatgcaatactataggccctgcaatggtttgcatattaagttcttctctacggttgtattttctcaagtttctataacagacacacataagctatggagtaatttttttaaaggacttttaaaaagatactggttaagatccacaccaagctgacatactggatgaagaaaccatgcttctagtttctgtgtcacattctccaagggaatgctgtaaaaccctgctggcatcccggaaatgaggagaaatattacctcccctaggaaaaactccttcactccctgagttaattgctcacttttctatattcccctagcactttgttctacaactattaccataccaaacatatagtttctatgttgaaattctttatttatacttctcattttccccactcaattgtaagccgctccaggacaaggagagtcatattgctttttgtggtcccatgatagtgcctgaaataaaaggagtttgttcaatgaatgagaagggttcttgctgcaaattcattcaaatacttttaagcacctgtgatgaatgagtatcattgcactgaaggtacccatcaggtggttcggagaaactttcatgtgcctgggagcagtccccaacacttgccctacaacccaaattttccaatgtcaccacgacaatgaaaagaacaggcctatagctgccagtacaacaagaagacccagaaagacaaggcaaagtaagaggcagaagagagtagctgcattgcaatgaaaaggaaatcaccctcctccctttgaatagggtaattgtctgttactggtaatgttgcatgtgttgcttttcttttttttttttttttttttgagacagagtcccaactcaccgttgcccaggctggagtgcagtggcgcgatctgggctcactgcaacctctgcctcccggattcaagcaactgtcatgcctcagcctcccaaatagctggaattacaggcacgtgccaccacgcctggctaatttttgtatttttagtagacatggggtttcgccatgttggccaggctggtctcaaactcctgacctcaagtgatccacctcggatctcttgccttggcctcccaaagtgctgggattacaggcatgacccaccgcgcctgaccataatgttgcatttctaaagacggtcaggcatacgggggtattcattttctttttatacttttcacatgttatgaataacttttatatgattcagtacttgctgaagccattaaatttttttcattgatttaataaacatactttaaacatctcctatgttctaggcactacgttttggggcttcagacatgaataagtcatagtctgtatctcaacaggtttgcagtcaaatatgagggacgcataaatagatacaacccaatgagatccttattttaaaagggttcttcattttatggaaactcagaaaaatggtctatccaatcatccctactgcttcccattccacaaggaaacaaggaaaacccacgtaaggaggaaaacgcaaattgcaaccaaaggcacagctcaaggttcaacaaccagcacgtcattaaagtgatcaaagaacccatcaagccaactcgtgcagaaacagtggttcattttcttcctttttcattcttcttcacatgtgctttattatccagaaaactagttgcaacttctaatatgtggaatcccacagagttttaaaaaatgggaaaatacgagtcagctcagctctgataacttaagctgcatcttcttgtgcagccacccaaggggaagagtccacgtgcagaatgcagttaacactgggagtcagcctccatctgcttaccacgtgtgttggtggccatgtcagccactttctgaaaggcgtccaagaaggcagctgctgctactactgttgtcctaaaatgcaaacagataacaaaagcataaggaatgtctctccctagcaaattcattacagctcaaggcctaaaacctctgctaaggagtacatgtaaccttcctccagaaataactcaactgagcatggacaaccactgtcttgctgaacccacttttttccaagtactccacccgaataatatccagctcattcggtgctaatcaataaatgctagtagcccttcccattccatttcatctgactgtataaaaccattaccagggccaggcatggtggctcacgcctgtattcctggcactttgggaggctgaggtgggtggatcacttgagatcaagagttcgagaccaacctggccaagatggtgaaaccccgtgtctacaaaaaattagccaggcgtggtggtatgcacctataatcccagctacttgggaggctgaggcagaagaatcgcttgagaccaggaggcagaggttgcggtgagccaagatcgcaccactgcactccagcctaggtgacagagcaagactctgcctcaaaaaaaaaaagaaaaaagaaacacctactaccaggcaaagttttatacaggaggaaaacagaggcatttctacctaaaaggaaaaataaaacattaaaaaatataagtggtagaggtgaaattaattttggagtaggaaagcaatatatatatatgcacatcagttgggggaaggaatctggtagaaagatcatgtagttcaaacaattcattttaggaataggagaactgaggccacaaatacgaggccacaaacatagccctagttcatactagagctgggacaagtatcccagcctcatgactcacaggcttgggcttgacccactataagacaagatcctggcagtgtgacttttctccctagatcctagttataatgaaactgagatactactgtttcaaccttaggacactatttcaactgaatcttccaaattcctacaaggtgagaatggggagaaggtactatagtcacttatgtcctagaaattattctgggttcttaatatttttttggacaccataggatgccttgagccctctgtggtctactggttccaagagtcatgacctaaggcatcattcagcgtagtcaacactccaagccagggccatggattccacacaaacaagccccagaactagaattcaaggactttacaatcaaacttgtaactaagtgttaattttcaagtatttcttatataactcagcctttactgagcgttcctaaggatgcaaagttgctgaagaagaataacaataaggactagaaagggaagatttcaaaatagagaaaaatgaaaccagctgtagtggctcatcctgtaatcccagcactttggaaagctgaggtgggaggatcacttgagctcaggagtttgagaccagcctgggcaacatactaagactccattctctacacacaaaaaaattgtttttaaattagccgggcacagtggtgcatgcctgtagtcccagctactcaggaggctgagacgggatgaccacttgagcccaggaggtcaagggtgcagtgagccatggctgcactactgtactccagcctaggtgacagagcaataccctctctcaaaaagaaagagaaaagaaaaaagaaagaaaaagggaaaggaatggcctttaaacatcagcaacagtagttttgaaacaaaaggttcctgcaaggtgctggaagtagttcctgggaaaatctaggcaacagtcccttacagccaaacttcaaaatgaggcctgttattttccagtagggcaagaaaacattctgctcaaaatttttaaaaataatgacatacatgtacacaaaaccactttgaagcatattttttaaagagttgacatcaaacacaaaccctggaaaaattagctttatcaaacttcttgggacttataaatagcttgttctgatttacaattaatatctgacacaatggctggatttattctcatccaactcaatgccaatcatccaaatttaatgaaccagctgcagaggtgtcttgcatattacacagtcaccagggctccactgaaaattaggcgggtgatcaagtttgaggcttttaaatggcagtcatatttcactgtccgctgtagtcacaagacatcttggccctctttgatggggcagagcaaacttgtaaccaacagaaacacagaggagtgattcagcttaaataaactaaggcttctatgcctcttctgcaatctaaacttcatcctttctctaacacacaaaattaaactatgtgcatgaggcccctatattgctctcagccctgtactattagtttaacaaaataataaagaaatggtccctgccttcaggacaaaacattgtttaataatataaaatgtatcctgtaccagtaaggacaggttaagattactttaaattttactttatatgtttaagacagctgatctgttcattactttaagcttcaagatcctcactgataaaaggggaagataacaattttcttggtctactctgaaagactgccagacggttaaatgaggctgaatcttaaaaaagtaggggaaatgtacttaaatgttttactgtattactataggaggagacctcccacaggataaagatgaagctacctaaaataaatggtaatcatggcagacatggaggtgggagtagatatggctaaataaggtgaggctggtgaaggactcaggtgaggagccctgaatcctgagcaggggaggtgggatctgatccagtagaaagtaattacaagagcttaagcagggcttaagtacaggacttgacaactggggaaggtgcagtattccaagttcactgtccatctgaggctgcagttcatggatggaaatcccaggctccaaacaaagctgaaggaatgaaagaaaaaaggcccacctttcccaagttctttagtctatagggcaccatggacactctagtcctatggctaacactctgggcagtgacccctggtgtccacaggcaaaggcccgagagcatcacatcatccctctcccacctctctgtcgtccacatggctctttatcctggaaaacccctgcctgccccgctctctgaaccatcttcctccatccaaaccaaccaatgacatcccctacatgccatgaaccagggccatcaaaataattcctttttaaaatgtcctatccttcatgaagcacccactaagtgaaattgtatcccttcaccacaatgatttaaaagggtagagctttaataagaagatgccaacgtattttctatttcatatcacatgatatatgaacaagcacgagactaggcaatcacagccccttagagctcagcactggatcttgtttaggcagctttacggaggcataatttacataccataaaatacaccctttttcagggtatgagtcaatgatttttagtaaatttggagttgcacaatcatcaccgcaatccaattttagaacatttccaccaccccaaaagatctgtcttacccacttctcactctcctttttcaccctatccccaagcaaccaatgatcaacatctctctaaagatatgcttttgctagatagttcatgtaaatggaattatacaatagtcaacacaaggttttattttattttattattattattttcttttgaggtggactcttgctcttgtcgcccaggctagagtgcaatggcacaatctcggctcactgcaacctctacctcctgtattcaagcgattctcctgtctcagcctcccaagtagctgggattacaggcactcgtcaccatgcccagctaatttttgtatttttagtagagatgggatttcgccatgttggccagactggtcttgaactcctgaccttgtgatctgcctgcctgggcctcccaaagtactgggattacaggtgtgagccaccacacccagccaacaggaggttttaaactctatttgtggagaggcagtaagcagaatggaggagaacatggactctggagccagagagcctaagttcaaatccttgctctgccatttagtagtgatgtgactatggataagttatttaacttcgctgtgcctcagtttcctcatcagtaaaatggggataataatggtatgtaccttgtggggttatgagatttaaacaagttaacaaatgcctggcacatagtgagcaatacataaatgttacccgttgctaccttacatacagtacctacctcatttgactctcaaaattcctatggaaggaggaaagcagacatgaatgagtcccattttacatatggcaatcagggcccaggatatatggctataggtgatcatgctccaatcagaacccagcacaggcttccctatctgcagcacttcctgaatcaaccctaatcaatctgcattttggtctgtcccactccatccttgtctgaggatgttgtccttttcctgtagaacatgtgcttctacttaccgaagctgggactgcagctttcctgctttgtttatgaaatcttcccaaactggatagctcccctgcaacacatcaaagacatcagtaagtcacactgcgatagacatctgattactacattaacagagcacccaattccaatcatgcagggaacaatctgtgtatgttctcttcctttgcaggtctgcaatacgtttcccggattctatatacatgtattggctcaggaatcagtttagaatgtgctcagttcctataatcttgtaaatactacaaacatcaactgaactagtttggcagaatctgacacatacacttttgagttggtagatggtgggtccaaatttaaggtgtacagaacatttaaagctccaccctgaaccacttgttcatgaaacatggccctggctgttctcccacttgccccaaacaacaccaagcagggaaccagagtgactggggctcttccccaggacaggtggttacagaaagcattaattagactatcagaatctcaagattgaaaaattacctaatgcagcagctcagctgatggcttaagcccaacacctagggacagtatagcaacaggtggttccccaacacacttcggctaacagggaactcatcaccttcccagcctattatcagccaccctgtccttgatgttcatgtagttctagttctaacctctgggagccctcagttaagatcaataatcctgcttccacatggaagtcttttcaaaatccagtttcacatccaaccccacttctccccgggaccctgcttcacaccctgactgcatcccagagacactcagcgtgtctctctactcttcctctaagtgtggtgcatagacacaaactcaaatctgcaggtgcaagtctgacagggcaaagcaggcagggaccgacgtctcccttcctacacatgttaaatttatattaagatcacacagcccaccaaccaagaggtgactcaaaatcaacacagaaagggggaaacaatgggctgagaagtggtatttggcattgatcatttaagtacagaactaagggccgggcgccatggctcacagctgtaattccagcactttgggaggccaaggtgggcagacatcttgaggccaggagatcgagatcagcctggccaacgtggtgaatccccatctctactaaaaatacaaaaattagccaggcatggtggcgcatgcttgtagtcccagctactcaggaggctgaggcatgagaatcacttgagcctgggagatggaggttacggtgagctgagatcgcaccactgcactccagactgggcaacagagcaacactccgtctcaaaaaataaaataatataaaataaaataaaacaaaacaaaactaagactaaacacctggggattatttttgcagaacagagcgtaaatgttatgaaccctgacaaggtaaaaacaacatatgctacctcttgattttcttgttcaggaaaggaggaaaaaattataatgaggttaatcaactcatctttcatgacagaagcccaattaaaactgtctaaaactgcaacccagctaaaacattaacagttttaccttcctaatggtattaaacatcattttttcttacccttagagcaggttctcagcctcaacactatggacatttgaggccagataattctttgtcgtggggggctgtcctgcacatttaagatgtttagcagtatcgctatcttccattcactagatgccagcgttcccccaccccctatttgggacaaccaaaaatgggacattgccagatggcccctaggggacaaaaatcacgcccagtcaagaaccactgccttaaaggcacatctgagaaatcaacttaaagaaagtggtgaagaaacaattacagtattacttcagtttcattttcttctgttaaatgaaagtacaattaagtatattttttcaaaagatcatgcatagcactcattataacaaggagcactcattataacaaggaacaccttgttatagaatcgtctatttatatacttccctagctgtcaattctgtctgaaaatgtacataagagatatctggaaagttgtctataaaatattaatacgggttacttctgggagttaaaatctggaccaatgtattgctttctcctttgtactttcctttatggctggagtcttgtgagttttctttataagggtcatgtatcattttaatgaaaacaataaagtcattgcattttttaaaacgtaagatcaaattagaggttctggcaacaacagcaccatgaatttacaatccacccgaactctaaagtctgtttcacgcatgctgctacaccacattcatcagttctgccttcatgcattggagacctgcttggctcaagcacaggtttctggatttattcctctaagtggcaatttgcccctatgggaaactaagcaacagccgggcaagaatcgtgtctggctggctcctggcagaggccctttggcagctacacctgagctactgtcaaccaacacctgtgtgagggtcttgtcacgacatgacctccatcccaagtgtgtgccctgggggttacttccacccaagagcagaactgtatattaatttatgtcaaatgaaaacttgtgagagctcaggctatcattcaaggcccatcaagacatagtggggactccaattatgacacccaacatacataccatttttttaatccagtccagataagaacaccccttgtacacctacatccaattaaagagatgagggccaagatcagagtcctcaggatggccactggagatctctgtccagagggacagcagttggcacctctaagaacacaaaggctcaaccaaccaatagcagcttcgtccgaccattccttctctttctgagccacaagacacgatgaaaagctttctgagaaatctgagcattcagaaacactgctcacctacttctaggcaaaggtgccaccatctctcggctacacaaggaagaaggaccaaagagccagaccctcctctcccaaacaccaaacactcccatccagggagccctggagaaatattattaagacgatcaaagtatttcttaagaaaaaggtgggccaggggcagtggctcacacctgtaatcctagcactttgggaagctgaggcaggaggatcacttgagcccaggagttcaagaccagcccagacaacatggcgagaccccatttctactaaaaatacaaaaaaaaaaacaaacaaacaaacaaacaaaaaaaaaacaccaggccaggcacggtagctcacgcctgtaatcccagcattttaggaggcaggtggatgaggaggtcaggagttcaagaccagcctggccaagatggtgaaacccatctctactaaaaatacaaaaattagctgggcgtggtagcaggcacctgtaatcccagctactcgggaggctgaagcagagaattgcttgaacccggaaagtggaggttgcattgagccgagatcgcaccactgcactccagcctaggcgaaagagcgagactccatctcaaaagaaaaaaaaaaaaacctagctgggtgctgtggcacatgcctgtagtcctagctactcaggaggctgaggtgggagaatcccttgagcccgggagatcgaagctgcagtgagctgtgattgtgccaccgcactccagcctgggcaacagagcaagaccctgtctcaaagaaacaaagccaaaggaaaaggtgaggcatgttcatcgagaacatgcagaactggccagtggcctgggcagggagcactgggtcctgaggtctagtcacagccctgccagtcatggactaggggaaatcatttcacttctcagggatcattcccttataatgatgataaccaaaacaaataattccatcaccattaccaataccatcaattattgaacattgaaagaatgaaggagatgaataaagattgcacgtacagaagcccaatctcttggattgaaccttagctctcccatttgctatgcgacactgggcaagttatttgacctctgcatgggtttaagtcacatcttcacagggctgagaggaggaacgaatgaggtcatatacagaaagtgctcggtgcagtgcccagcacactggaagtgctcaacaaacatttgatatgagggatccaagtggccacaggctctcagtaatctcctttaggatgtgtgggggacagactgtaaagtctaagtcagactgtccatccagactggaaccccccttttagagtacctggtgtggaaccagccaacatgggaagcatctgcatctccctattagtaaaccagggttaggcagaaacagaccaaggcaaaggcagctgggtgttcagtgccagacaatttctctgctgctgctaagcaaatggcagggtggagtactcaaccctgagatgagtgtgcctgaaaaagacgactactcaaaccactgaagaaacttcttatctgcccccacttggagcgtcatttcagtctttaccaaattagcaacaaaaggaggggtcccctttctagtcaaggggtacagctaacagctccccacctacgaacatccacccagccagaaggttgcccaaagtagcttgctgctgacttaatgacacttgacagtctatcagagagagtcaggcccacctgttttaggcaatatataatttaatagattctaaaaaaagaaaaaaaatcaacttctaagaacagaagacaaaaacctccttgttgagaaatgaaaaaaaaaaaaagtgagtaaatgtcattaaaatttaaaggcaaagtgatgttgggttgttccagatatttttgtaagtttctttcaaggaaaaaagaagtttctacccacctgagagcagttttactataataattcaagcttagaggaagtaagaaaggaggaagaaggtaactagaaagattgaaaggcagcagagaaaaagtcctgccttttggacagcaagactacataaaggagaccatactcaagtttcaaaagaaacccgcaacccaagacactggaagctcttagagccctttagaaagcaattccccaactgtccttggtttttgcatctgcatccacccaccaagaagtccccagaaagttcattcctgaggttgctggctgagctctgtccccatttgaggaaatccctcggaatgcactcccagagccgtgaaaacaattcaacacagaccccactgtggatttcacctgagaacacataaaggcttcacaacgttccagacagacccaaatcaaagaaaacaaaactcccgccacgccccggcttctgccaagtccaaagtcacaaggcaaaatgagaaggcgcacctcctccaggagccccctgaatttcttcagagaggagagccaggagtttctggagcccttggcagtgcgttcgttgaaaatacaactcagattacactgggttctaagaaaggaaaaggtccctattaaagaaacgggaagagaaagccagtttgtttacaagcgtgtaaagaggactccctccatcacttccttgggtgagagatggggcttccctgaacacgtgatctcacccacactccccacacacaccacaccctgtggctgcttctcttcaaatctccagggggattcagcaatattgaaaactcctattcagctgtcactacccagctgtgacacttcttctggaacattctctgacacacccccttcccacctaccctctggtttagctgcacctactccccaacttatcacatcatacagtttgctgtctataagcctgagggcttcccctttggactgtggaacaaggactgagaaatgaagggaggaaggaaaagtacttctggtagggggtgcagctgacacaaaaggaggcagggaacactgaccagctctctccaagggacactggagtgacacatttatgctggccactcctccaggcaggacatgggcgaagtggcccaggtgggcaagggcagccttccagggcaagacccagggtggggacttgggacaggtgaggaagaccggggtggccttcattcagacagtgagtgacataaattccagaccagacaggtgatgggagaacctggctaatggtcacatacctggcatcactctagttcctgggagagagaggaaaataatgaagtcattttcttagtttttaggaaaaaggcctcctaaatctccttcaactgaagagtttggtggccacctaaacaaatccacaagttggtctcccccaccccaccctcaaagtggagcttaggagacaccgccgagtgcctctcctcatcttcctcctcttcctccactttccctagagccaggacccatggcaggccatttgcctaacacaaagcaaggcacagcaatcggccaacagccattctggcttagggttgtttggcttcgttttgtttcctattgaacagaggcccaggacggcatcccacacatggtgcagagaataactgtgtgtagctcatcagcacggctggtgaccggtgctccataaataatgcagcaactgcctctcccagcccagcgccactgggacagctgagggaattcaacaccacgctgccacacaaggaacacaggggccgggaactgccagagaaagggcaacttgggaggagccacagagctggggaggacttacgtgaggaggaagaattcagttcaggggagaatcaagtaggaaccaggagggcagaggctctagagagtggggttccagctcaaaggcctttgttctgcccaaaaggtgccagacagaggctggctcaccagtggatctggctgagaaatcaagccgtggggtatatgaccagccaggtaacttcccaagtatctctgttcaccttgacaagcatcactgtcatcaccatcatcatgaagcatcaccactttctaaagagttgccaggtgccaggtatatatactggcccttcccaagctgtaatttacatatccatcatctggggagcttgcagacaggcaggttctgatttgcttggtggaggtggggccgtttaatctgaggtgctgctgctcctggtccacagaccactctctaaggagcccagcttgatcctgcattctcactgcatgctcacagcagcccaggcaggcaggtgctgctgttattttagagctgaggaaactgatgcccagagaggttggagcagagagctccaggttgcaataggatgccagatctgactttgcagcccaagtgttccctgattctgggaagtgcaagtaaccacatgaacagagccagcctccagcccagcccagccccagggctgcaaagagtggcttagacagcaggttgggtcgcgctttacatgtgggtcctataagagcccagacaaggtagagcagaagaggacaagggtgccctgcacacatggcacctgattacaactgcagatggcccagagggattgtaataccaccctggaaatggtcaggacccccaaccacatgaaaaagaaagcacgaggctgggcgcagtgcctcactcctataatcctagcactttggaaggctgaggcagatggatcacctgagctcaggagttcgagaccagcctggggaacatgacaaaaccctgtctctactaaaaatgcaaaaaattagtgcagcatggtagcacacgtctgcaatcccagttactcaggaggctaaggcatgaaaatcgctaaagcccaggaggcagaggttacaatgagccgagatcacgccactgcactccagcctaggtgacagagcgagactgtctcagaaaaaaaaaaaaaaaggaagaaaacatgaaacacacaacaaagagtgggtagaaaaatgcctggtagaaatgcaccaagaggttcatagctgttggcacttgtggtatgattatggataattttatctcatcttggttttctgtgaacacacaaactggtcttcttctaccaggagatcagtagagtcaatctgggaggggcttttaaatctccagctgccacagccacccctgccaccatgaccccttcccaggtctgcggagacctcagcagggcgagtgtgaggaacatagccaacagcatccttcctcttcttccgctgggtataccctggatgagctcagccttcaggttaccctgaagctgctttacgcagcttccagaggaggctggcaccttctgacctacgctggagtggctctggcctccctgcttcttcaagcatgaggcaagaatccgctcagcttccagaagtgggcgtgtgggatgacagacagggcccatgaatgcctgtcatagctttgtccccaaaaccacccttccccacccaatcctgcaagatgaagggctcctaagatcctcagatgaaaggcactgggtaagcccatccatcataaataccattcctgggcttttattctctgattgggggttgcctaatccactaattatccctgtccatcaagcggatgacagccttggggataatcaatggttgcttcctcgcccgcccaccctcacccacttgcccaagcacaccagcaataaatatgcctatgaaaaggaagactgaaccacaaaaggtgctccctctgtccatccgtccatctccccttacaaactgctccatttgtaactattaacaccctaaccaaacaaatcaaggatatcaagcttttcctcctcccgcattactaggttggatgcccgggctgttttctgacatctgggtgtctccacttaaaataaaaataaccaaacaaatatgtcaaccatatcttccaagtcattttcttaagttttccaccaggaagtattcctttgtctatcctgagctgtccaacaggggagccccacatgaggttatttaaagtatgattaaataaaatttaaaattcagtttttcagcccactagccacacctcaagtgctctgcagtggctagtggataccgtactggacagcatggacacagaacatctctaccactgcagaaagttctattggacagcaatggccaccccaccacaacggcacccctaagggcttcactatcttagggtgctctacaaccacagctaggtttttggttctattttttaaccactgtaaaatgtatgtatgtgttccatgctccacatttcttgaaaaatagaatccctctcctttttcatcccctaaattcaactcattccccaattttgggtttgttttgagacagtcttgctctgtcactcaggctggaggtgcagtgatgtgatcttggctcactgcaacctccgactatgaggttcaagagattctcctgcctcagcctcccaagtagctgggattataggcatgcaccaccacgtctggctaatttttgtatttttagtagagacagggttttgccatgttggccaggctggtttcgaactcctgacctcagatgatctgcccgcctcagcctcccaaagagctgggattacaggtatgagccactgcgccctgcctgttttcttgttttgagacagggtctcactttgtcaccaaggctggagtgcagtggcacaatatcagctcactgcagcctcgacttcccaggcccctcattgctgcctcgacttcccaggcccaagcgatcctcctgcctcagtcccccaagtagctgggacaacagggaaacactaccacacccgactaatttttgtatttttagtagagatgggttttgccatgttgcccaggctggtctcgaactcctggattcaagtcatctgcctgccttggcctcccaatgtgctgggattacaagcaagagccatggccattacggccatgacatttcctttatgatttcagatagttcctcccatcaaaagagagaggaagaggtttatggttagtcactgcctgcatcagcagccacctgacatttgtatggccaagttttcaaaggtgaaaacctgccatgtgggaatctaaactgacgtcatgatgggcactgaaggcaccgcctcacatgtatgctgtattcgagagtacagaggtctttcaaaacaccactgaaagggcagctggtagaacaggcatttaacacttccctactaaccataggaaaatcgggcacagaaagagtaagtaatttgcccaaagtcagggaagggcttgccctcacgcccggttaactgcattaactgttatttgctcctaagcaatggttaattgctcctgagtttgctcagttgtttttgtttttgtttttgttttgagatggagtcttgccgtgttgcccaggctggagtgcagtggtgctgtcttggctcactgcaacctccgcctccagggttcaagtgatcttcctgccccagcctctgtgtagctgggactacaggagtgtgccatcatgttcagctaattttttgtatttttagtagagatggggtttcactatgttggacaggctggccttgaactcctgacctcaagtgatccacctacctcagcctcctaaagtgctgggattgattacaggcatgagccaccactcccagcctgcccagttctttttaaaataaaattgtataatgggttcacctaagactgactgattctccacatctggaaacctgggaactcaatatttaaccacctaatacaggggctggctgcttttacctagcatttgtataagcttaatcctccccagaataatacatatctaccctctaacctttgtcctcctatccagaggccaaagctattgctccatgtgtttattcctgtctataaatgtccacattagatattgaacctgagcaaaacacctagtggcttgcacaccctatgaaatgttagaccttctaagcgtgacttcacgttggtccatttacactcacccatttcttttccctggaagtgtccgctctgacctgcctctacccaactccaaaactgcttctgcattttagggattagttcctcttggggccaatctctccaataccctgaacagacacacaaacaccctctaccctagagaggatcatgtttgaggttttgctcccctaaatacacacatacctctgtattcattccatattcccttttttatgttcttttctttttctctttcttctttttttttaatttttgttgtttaatttgttttcttttccttactttttttaatccatattcccttttaaactgagacctctccgcagccaagggcagcatgatgaacttgtcacatccaccctggggcaagcactggccttgctgcgctatacacgcttagtgtgctctgccatcttccacgaagcagatttcccctttggaacggagacagatagcacctcctctgtgacctcaactcccaccccaggctgctaggaacgatgccctggtagccagtaaagagtcaaaggccaccagtgtcacagtgataactgtgtttgtcatttccatagccattttttttttaagtgtctttccattgaatgtcatttttcttgcctggcgagagggcgctgaggtgtagccatattccagagcctgaaaagccttgtgtggcctagtggttaagagcatgactctagagtcagcctgccaattccagatgtgctcactgggtgaccctgggcaagtaatttaatcacctggtgctgccctgtcttcatctgtaaaggacactgatggcagtccctgcctcaaatgatggttgtaggatgatggggaaaacaacaagtgtttagaagggtgactagcaagtagaattcaactctgctttgatgactcaatgtacgatgccaatcaccctgactgggccatgaatgggcacctactatgcgcaggcactgagtgaggggtgggccatagacagaaagagaccaaagcgttgaggaacgcagtctagcagtaaagctgatgtggaactgcagatcccaaagccccaagggcagcatactcgagatataaagtgctggacagtgcggttcccagagtgaggcaatgcctcacctcggtctcagaggataaatgggaattttcttggcaaagagaaatgaaacaaagagggaggaagcgttccctgcaaaagacagaattagcaaatgaaaggaagtcgagatcatgctctgcctaggcacagaactcatttcgtctgcctgatcgcattccaagtatatctgtggtggagtcggggatggggacacatgtgcgggagatagctccctacatacttcaagagctgcagaggaagctctcagtggctcaggtgacccagggggcactcccacttccacctactcctggtggaatcccagcaagacctatcagagaatgacctgaagtgtttgctaacactacaggttctaagccccacccccagatcaacaaaaagtctcctgggatggagccagggaatctgcattttaacccattctccagggacacttttgctcattaaaaattacacacagcaagatttgagaatcactgcactagataagatgccacatgtccctttgcgcccttggaagcaggggtgccagctaggtcccagtgtccacatctagctcctttagatgtaatccacggtggtgagccctcaaacatgggaattgggaactgagacatgttttttggtaggctttgggtaatgggtttcaaaagccttgaaaaaaacacacattttgaccaaggataaaaagtccttcgggggaaatcactgatgtaaatcaatgtctagtcacaaggatgtacttgttgtagggttgcttataattagtaaaaaaaaaaaaaaaaactggacgcaacctaaacacaaatgagggaggtactggcttctgcctcagggcttctgcacatgctctcttcccttgcactgaacactgccctcaccccctgcccacatcttcacggttcttaagttgttgctctaacgccacctcctctgcgaggcccgcccctaaccactctacttaaaaacagcaccagactgggcatggtggctcatgcctgtaatcccagcactttgggaggccaaggcgggcagatcacttgagattaggagttcgagaccagcctggccaacatgacaaaaccccatctttactaaagatacaaaaaaaaaaaagccgggtgtggtggtgcatgtctatagtcctagctacttgggaggctgaggcaggagaatctcttgaacctgggaggcagaggtggcagcgagccaagattgcaccactgcacactccggcctgggggacagatactcgggaggctgaggcaggagaatcacttgaacctgggaggcagaggtggcagcgagccaagattgcaccactgcacactccggcctgggggacagatactcgggaggctgaggcaggagaatcacttgaacctgggaggcagaggttgcagtgagctgagatcgcgccactgcatactccggtctgggggacagagcaagactccatctcaaaaaatatatatataaataaaaattaaaaagaaaaacagcaacagtgctttttccccattgcacataatcctactatacaagagaattgacttattccatgtgtctccttcaactgcacctcactccactagaatgtaagttccaggagggcagggatttgtgtccattgtgttcactgctagagcccagcacttagaacctggtactagtagcttctcaagtatgttttgaccaaatgaattaattagagaaatacaaagcagtgcaacaccacacagccattaacaatggcactgctaacaactacacacacggaaaggcaaggacgccaggccgctaagtgaagaaagaagtttctgacacagtcttggctccctgaccctttgctgaaaatgtgcgagcccttgtgagtgtgaacataacccactttctcatcaagcgcttgtgggtgacttattttttacttaactgaagtttctagtttttcttccattaactttacgttacttacataatctttgagaagtaatccctcatgaaatgctctcaaaacatctgctaattttttttttttaagaaaaaagcttcctcctcagtgacttaattagggtgttcctaattaaggccagcacaacatcaaagaggccaggttccaggggacccccgctccaggtcaacttctggttgcaggatgacctcagtccctccagcggaggctcagacagagggcttggctgtcggctagtcctggctctgctccccgctccctgtttcctattggggtgcctcatccaattattcaggccctcgatcacatcctgctgccgagcgggctttgaaggttcagtaaacagccacttcaaaacaaagaggggccattaaaccaaactcaaagacttccttaatggctgcgtgctcggctgcaggagaggagtccggcctcaaaagggaggtctccctgggaactaatccctgagctctcccagcctccttctgcaaatatctgcccgcttcctgctctgcactcaatcactcggggtgcagagtggttactggagcgacccttgacagaggggctcctccagcaaaacaaacatgtgtcgtgtggctgccaccttagacaaccctattgcacacttcgatctcacagctcagctgctcccaaaaactgcactggcctggcccaacaacttcatgtccgtggccagggcatattcctcttaattagagggagaccccttgagcttctggaagaaactcagaggtgagtctagatttttgtgtgttcttatctgtctcatcctgagtcctaatggtacaaatagagcgatcaaggacatgaatgaaatacacctgttacagaatctaaaatgctaggctgcaaaagcgagagagagcccagtcctgtggagaggcacacagaccctggagccagactgcctggactcaactaactcccagctatgcttctcactagctgtatgacatgggcaaatggcttaaccgcgcagcacctcagtttccccatctgtaaaatgggaattatactagttactaagactacctcgctgggtggttggaagattaaataagtttgtgtcaagcacttagcatagtgcctggtttgcatataaatgcttttaaaataagcaaaataaaactcagttccgagcgagggtgtcacccagatcaaaagccttcctggactctgtactcccaccctaaatgggaatcagaggccctccccagagcccccacacaatcttgggctgatctctatggtggtgtggattacactgaactctaattacctgcctgcctgtctcctagactgagcacttcagggcaatgactgtctatactgtccacaggtgttcctccaccccccagcagcacctgacatgcagtagacatgccatcgtatttgacgaatacatgtactgtgtcctctcaaattacttatatgttgaatgttgaaaagcactgcacttgtctctactgcattatcaaactgaaggcataggttgcttctattctttgaaacatctgagtgccactatcagcaggaggttctgccaggaattactagggtggctcaaatagatacgagcatttatttagcacttatttcatgctaagccctcgacttttacttatttaatactcaacaactttaagagggaaggattattcacctcttctcccattttacaggtaagaaaatcaaggctcagtaaacttaacttgctcagagcaatagagctaggaaacgctagagccgggcttcaaagcccaaggataaccactttttaaggtaggatataatcaatactaggtagaatgtcacaaagaatgtgaaaaatggctttagggttatcgagctttgagggaaaaggaggcaccagagaataaggtcactgtctaatggggcctaaggatgagaaagatttcagtaggcagcaatggcagagacaggacaggacaaacaacaaaagtgaggagcacaggctgtgtcaaggaagcctgggagtccgagttagggagcactggacacatagcgggccacttagctggggccaaatcacaggtgtcctcacacaaaaggttaaggcaggactgccacattcggcccatgggaagaacccagatgtggccaagacttgggaagctgctgccacagggcagactagaggcacaggatggccacttttggtggttgccccagaaaaaggaggaaactcaaaggatgtagatgggaaaagatgaccctaataaagcaactttccctcccccaggcctcaatgtatctgacttacaaatgtcctagccaaggaccccaccctctccttccctaataaacaaacagtagggtttgcaaatacagaatgcaaataggtcctgctgggccagctgacctttgtaatgaactcaggggcgatttacttagcaagaaaaaaactcaacttctccatttcctgcaacttcactgcaagctctaaatacagctccataagggtggggcagtgtctgcctaagaagtggtggagataattactccactgattctaagacttcaaaatacctcattcccaaatctacaagacagaatagtaactgcttctaacatttgagtggacgttcgccaggcaatgtgtgaaaaccttcacaagcaatgtttcacttcagaatcctccaacaactcttatcaggttcatcagacccattttgcggaagaggaaaccaagacttacagagattaaataactcgcccatgggatttgagtcagattcctttaacttcaaggtcaactctagctccagaatttctatggaggggtttaggggcagtgttgtagccagcagaaggtagaagatagaaagctgtgttgcaacgcaggcacactctaattctctagatgatatgttacagatctgcaactgttccgtacggtagctactagccatacacggctatttaaatttaaacaaatgaaaagtgactaaaaataaagtcaattccttgactgcactagccacacctcacgtactcaatagtcacacgtggctagtggctcacgtatttaacaatttccatcatcgcaaaaaaaaaaatcacaacggacagaatcaataaatcatggcaaagtattctaaaatcctttgttgctgtttatttttatgtttcagtttatttactttaacatttaactctaatttttttttttttttttgagacagagtctcattctgtcgccaggctggagtgcagtggcgtgatctcagctcattgcaacctctgcctcccgggttcaagcaattctcctgcctcagcctactgagtagctgggactagaggtgtgcgtgatcacgctgggctaaattttgtattttttgcagagatggggtttcaccatgttggccaggctcgtctcaaactcctggacctcaggtgatccacccatcttggcctcccagagtgatgggcacctcgccctaccagaaaaggctttgagggaagacttacacagctcagtgattctcagccttggacatcaccagaattacctggggtgcttttcaaaatcttaatgccatgaatgtaccccaaggcactgatcagagccctggcccaggcagcagcatctccaagctcccagggaacccaatggaccctgctctgtaaccacacgcatgcagccaaatgaggtacacctgcctagaacctcgccttctggtgagacccattcccacggcccttggagcccctgtcgcatagtaggcagcagaggggacccaggcaaaacctgctgcccacctccatgcccaggaagctgctggtgctgagtgagctgaaactttctactgctttgagagaaagcaagcaaataaaaagacacacagttcaaaaggcactcaactcaattgatttttttttttcacccacttacattagacaggaaaagaaaaacaacttagaacctatgaccaaggccagatacgccaagaggcagcacaggaaggagttttgttggtgagcccatccacttcttcaaacacagacttacaagggcccttgtccagcccccagagaatcttaaacaacccaaatcctcccatttgctcagtaggtaaaaacactgtcacctccaaacaaatcgggaagcaggcgagatgagagagccccaagcctaggacttccaggtgttgagacggggactgctctggagtggattctgcactgggaattgctacttttaagtttttggttgttcggttgtttctgatttgccttggtggctcatactcagatgaaacctgcagtctactgctaattcaagggagaacctcagcaatcgtgacaatgggcttccttaatgctcagccaattaatttactcctcaatttcattttcctctcctgtttgctacttaataaggccatatcagcagtgctatctccaaatctgagttaaacggctcacagcatcagttagttccctttaaatggcccccaaatttcttgtctgacatcctaggcagctaaatctgtcctctggcttttgtttggtctggagtgaggtatttctttgtttttgcagaggtgtgggtttttggggtaagtgtcctgaaggcagttccgagaagtaatggggaactcaaagtgacctcatttgtccatacccaattcgaacatctaaatggtctcactacagaaggaatcttgccagctatcgccacccatgcccgtgaagatggaaaaagccgagatgcaaattggagataaagcatctaatgaatcaatagtttcaaccttttcaccctccaagcattttaacagccttaagtaagctagccaaattgacagacatcattttagcttttttccttttccctgtggctgaggtgcaaaagaagagttcaaagggcaagaggtcagcaactgagaacacatagcacacagggaacaaacttaaatagtgaacaattttttagtatatctgaaatgcaaatttaatgggaaaccctacgtttttacttgctgaaatcattatgccacgtttggtgcctgaaacaccactgatgctcaataaatactacggaatgagtatatgttactctagtaagaactgggcaatggctgaaccaggcaaaatccaaactcagcttaccttctatgcaaaccaggacctaggaatgacttctcttgatttggagcattacaaactgcggaatttcagaacataaaggttcacagcatcaagctagaagttccaaaaaatttgactaaatagtaaagggttttcacaaaaactaaatagggagggggttttcacaaagaaacactcaaaccagtatagaaacgatttccaaacaacaaaattggcacccaaaaaaccaaaaagatgactctacatagaagaggtcctaaatctctgggcacccatcccaggcagttcctgctgtcgattttatgacatctttacttcaccttcttctcccatgggcccaaaacgaggaagctgtaaaaccctggccaaatacaaccatttgctaagagaaaagccaacatggggcccatgtgtcctttacaagtgctctgcttgtcctgcctttggtggctgtcaccgtttatagggagcagcccacctccctcagagcacctggctgaggccttggttgggttttcagtgctgtcctggagaaaactttttttttgaggcctccaagggaactcctgcagagactgatgctcttctctaggctgaaccacagcccttccttcatgaccaccatattggattcatattacctgtttacagcccacaggacaaggagctctccaagggcagagcctagcaaaaggccttctacacaattgccctccataaacagcaaggaagtgtatctctcttctgatgggaaccccaaaacaaagcagtgaggggtaaaaaaaaaatcctgaaatcactatccagtgttggacccactacccacattctccatcctatgatatgggagggaaaatatcacgacatggcttcgaaccacaaaaagatttccatggaattcaagaagtccctttagcagttctaattttaggcagaacttaggaaagaggatagtgatggcaaacacaggtggggggcggtggggaggaactgaacaaggcctctattctgctcagcacaggtgctggtaacaggacacccctgtctaaagtgacacatggggtggaggaaccaggtgtggttggggttgtcttgcgccagtcacattctatactcctaacctcgtacaaagttctccccgcagcaggcccagttcagctctcgacatgctgattcttgagcaacaagggtgaagaaaatatttgatttcagacatccaactttgtttttttaacccaagttaattattaaaagaagaaagacatccgcagagtgagctgtcctcaattttggccagcaaagtctcctggtcttaagaactccccagacatcaccaaaatcgatgccggttcaatgactcaaaagcaaaggcacaaagctgctgtttgagacatggagccctcccttcccagagcttggatagaaactccaaaaagattccaggacctccttgatgcagtcaagatcgtctacacatcggaaggcagtcaacatcacttccagactactgttccccagacaaaccagctatgggcccttccctccagccacgtgaatatcttgtctcccctttcctctggaaccaactcacaccagccaatttgatcagcgatttactaatttgcatggatgggaggaaaggcagccagtaggtgattttgcacaacaccgttcattagcgaccaccaccacagcagggtagaataaacgggaaacaaaccaccaggcttcctctcgtcaaggaatcgatatgttgtttactagctgctgcttgctttacatggtgctgttccccagtggagaaaaagtcaggatttcttccacaccttactgcctgaaaaggataaaacccatgccctgacagccagccgaggacttagatgaagcatctttagaggaaagcacaaagaatcctctctctcttgcttttccatgtcttgaggttctctggtttcagaagatggagggtgccaggccttgaaattattccttttattgttttctttttttctccaaagaggaaattgactcccttcctgtgctgctgtacattttgaagaatcaaatgctactaataaaaccattttccttatccttttctcacccagcctaacatcacttctgagaaaataacctaaaaatttttatcaagatggcattccaaatgggtttccgacatttacgcttttccctcagagcaaacagataggagaccaaaggcattataaacccattatgggagtttaaagaagagaacaagaggataagcaggtcattagaaagtcagttgatttcagatattaaaaactgacttttgttgctggtgacttcatgcatctgcacactatatactgcttatcagatctgttcaaatttaaaaatttttaatttccatttaaaatgtcactgtcatctaatccatgatgaagtcttttaagaagcaaagtccaagaaaatattcaagaattgtcttatgcataaacaatcttggaaatcagacattccctctctcttcatctctcgagtctccaaaagtctaaaactctgcagaacccaaggcatgttttagtcttccattccaccttgcttttaaaattttactgccaaaacaaacaaaccaaaaaaaaaaaactttaaaataaatgatttcccataggatactgaacaaacctactaaactcaaaccgaaagaagtcaggatacacaaactctagattccgccgtgactgggcattaaagaaaatgtctttatttttaactggaaccatgcaggggaaaaaacaccaccttggcacccgtgagtccccagccagggcatagtgccacgcagccacaggatggcaggtggaaagcaggacagcccaccctttgggcaggtcaccttctgaacggctttcgattcaaacagtgaatgggaagaaccgagcctggattctggattaaagaacaaagagaaaaaactccagatgtgatcactccaggactacagtggacagatccgtcagtgtgcactgggggcaacagaatgaaaggggctgtctttcaacagggaataatccatctaattccaagtgcctggactataagcattcctgggcaagcagagtctggctgcagattatgctatgctaaggacaatttgtgacaaaaggcacgagagctgtagaaagatttcaaaatggacaaaaccaggacagaggcagcttgataaagttcaccctgggtgaggtggcagttggttctgaaaggtggaagcaggccatgacagctgagcattccttcccaaagaccatctccgaggcacgaagcctctctaaaccttacacttcatcagacaaaagctcctccaggcgcccaggcagcggctgaagaggggctgtccacacccactcggtgcacagctttccaaacctgcccactcgttttggaagcgagcttttaattaaacaccacctccccggatctggatctgttgaggcaaactggggctgggccagagccaaagagaagctccctaaatacacattaaaaaaataatttcccccaccgctcccaattcccacctccagccagctcgcgcggctggttttatttcctctggatgaataacacggggccctggtctatctctaggcaccagaaaatccacatccgaggatcaggttatccccagtcccaccctttgcaggaaaaaaccagggtgttgttccccgcccccacgcgcgcgcgcgcacacacacatgcacgcgcgcacacacacaccatcttcacaacccttccaagagaaaacctagagtgtgtgtccgtttgggtctgggagggcaggatacagttatttcgggggccccaatcttgcctttaggctcagctgggagaaggcggggcccctgcaaggctgcccgggaacttcggccccgcgccccgcgggagggctaagagagggcacgcacacctttaccagcttcggaacggcccaattaataactaatttgctcagataccccactccaagtagacctgacagccaaggagggactggctttccctctcagtctcctaggctaggggactccttcctgcgagcgggcagagcccccacttcctccccaccaccgcgccaggcgcccccaccccgtgcccggaggaatcaggtgtcctcccgggcatccagcccccgcgggtcccagacacttacttcagggacagacaatgggaaaacttgcagccagtgccttgagcccccgagggaaagaaatggtgccgccccctgggacaatgagcgggggagatggcgtgggacagcagacaccccccagagaagccacccgcccagtgaccccgcagagcccggagcagcgccccgggtgagcaggtgacactccggccgggagctcccgcaggtggccggtggccacactgcagggaagggccgggtgcccggcccggggtggaggcgaagcgcggcggcgaggtcagagcgcggcggccggcgccgcagccgcacccccggcgtcctaccttcatgtcgctgatgatggtctggaagaggcctccgagcgcgctgcattccttctcaatcacagcctccattttcccggctccggcagggcgagggcacacacgcggggccgctggactgcgcgcggggccggggctcgctcaccccagaaggaatttcaccttccgagagacccacctcggactcgcagcctcttctgcagcgaggacggggtgcaccagaccgactgttctctgcccaaaataataacagtaatttaaaaagccaaaccgctctgtagggtattcgcctacaagcagcgctcggctcctggccttaaaaatgccgggagaagactgacaatcaggccaccactggtgcccactacggaaacggcaaagcccatcttgatgcagagaaaatcgcccgctgacccggggccagcgccattgaaaaacgcaagattttccaatttaataaatttttctgcaattaaaaaaaaatcgcccaacagcagagcgggtcagctcgcggcgtccggatctgttgctcgcagctgcggccgccgcctccttttcactcctgcgcgcccggccccggcgctcgctctggctgggctcccggggacgttcggaggggcgcac

The invention claimed is:

1. A method for identifying a fusion gene in a sample comprising obtaining a sample from a human patient; and testing the sample by in vitro analysis to detect the presence of a fusion gene or of a gene product of a fusion gene in the sample, wherein
   a) said fusion gene or gene product is a CD74-NRG1 fusion gene, the gene comprising a sequence consisting of the sequence of SEQ ID NO:2, or the gene product of such a fusion gene, the gene product comprising a sequence consisting of the sequence of SEQ ID NO:1.

2. The method of claim 1, wherein a level of expression of the fusion gene or gene product in the sample is determined.

3. The method according claim 1, wherein the presence of said fusion gene in the sample is detected by in situ hybridization.

4. The method according to claim 3, wherein said in situ hybridization is selected from the group consisting of break-apart in situ hybridization (ba-FISH), fluorescent in situ hybridization (FISH), chromogenic in situ hybridization (CISH) and silver in situ hybridization (SISH).

5. The method according to claim 1, wherein said gene product is mRNA.

6. The method according to claim 5, wherein the presence or amount of said mRNA is determined by RealTime PCR, ReverseTranscriptase PCR, Whole Transcriptome Shotgun Sequencing (RNAseq), in situ hybridization or micro-arrays.

7. The method according to claim 2, wherein the presence or amount of said gene product is detected by immunohistochemistry (IHC), by immunoassay, gel- or blot-based methods, IHC, mass spectrometry, flow cytometry, or FACS.

8. The method of claim 1, wherein the human patient has cancer.

9. The method according to claim 3, further comprising the steps
   (a) contacting nucleic acid in the sample with one or more probes;
   (b) incubating the nucleic acid under conditions allowing hybridization of the one or more probes to the nucleic acid; and
   (c) detecting hybridization.

10. The method according to claim 6, wherein the determination by RealTime PCR or ReverseTranscriptase PCR further comprises the steps
   (i) contacting nucleic acid in cells of the cell sample with one or two oligonucleotides
   Forward: CTTCCCGGAGAACCTGAGAC (SEQ ID NO:19) and/or
   Reverse: ATCTCGAGGGGTTTGAAAGG (SEQ ID NO:20);
   or
   Forward CTATGGATCCATGCACAGGAGGAG (SEQ ID NO:23) and/or Reverse GATCGTCGACCTAT-TCAGGCAGAGACAGAAAGGG (SEQ ID NO:24); and
   (ii) generating an amplification product of said nucleic acid.

11. The method according to claim 8, wherein the human patient has a lung adenocarcinoma.

12. The method according to claim 11, wherein said lung adenocarcinoma is invasive mucinous adenocarcinoma.

13. The method of claim 8, further comprising administering a selected cancer therapy to the human patient.

14. The method of claim 13, wherein said therapy is selected from radiotherapy, surgical therapy, neoadjuvant therapy, adjuvant therapy, anthracycline/taxane chemotherapy, therapy with an anti-metabolite agents, therapy with an anti-hormonal compound, therapy with an anti-estrogen, therapy with a tyrosine kinase inhibitor, therapy with a raf inhibitor, therapy with a ras inhibitor, therapy with a dual tyrosine kinase inhibitor, therapy with taxol, therapy with taxane, therapy with doxorubicin, therapy with adjuvant (anti-) hormone drugs, and/or therapy with cisplatin.

* * * * *